US012702708B2

(12) United States Patent
Xiao et al.

(10) Patent No.: US 12,702,708 B2
(45) Date of Patent: *Aug. 11, 2026

(54) PRESENTING CELL AND USE THEREOF IN CELL THERAPY

(71) Applicants: Innovative Cellular Therapeutics Holdings, Ltd, George Town (KY); Innovative Cellular Therapeutics, Inc., Rockville, MD (US)

(72) Inventors: Lei Xiao, Rockville, MD (US); Chengfei Pu, Shanghai (CN); Zhiyuan Cao, Shanghai (CN); Zhao Wu, Shanghai (CN); Le Tian, Rockville, MD (US)

(73) Assignees: Innovative Cellular Therapeutics Holdings, Ltd., George Town (KY); Innovative Cellular Therapeutics, Inc., Rockville, MD (US)

( * ) Notice: Subject to any disclaimer, the term of this patent is extended or adjusted under 35 U.S.C. 154(b) by 646 days.

This patent is subject to a terminal disclaimer.

(21) Appl. No.: 16/999,357

(22) Filed: Aug. 21, 2020

(65) Prior Publication Data

US 2021/0100841 A1 Apr. 8, 2021

Related U.S. Application Data

(63) Continuation-in-part of application No. 16/996,237, filed on Aug. 18, 2020, now abandoned.

(60) Provisional application No. 63/054,017, filed on Jul. 20, 2020, provisional application No. 63/046,859, filed on Jul. 1, 2020, provisional application No. 63/040,851, filed on Jun. 18, 2020, provisional application No. 63/005,866, filed on Apr. 6, 2020, provisional application No. 62/932,587, filed on Nov. 8, 2019, provisional application No. 62/902,766, filed on Sep. 19, 2019, provisional application No. 62/891,131, filed on Aug. 23, 2019, provisional application No. 62/889,926, filed on Aug. 21, 2019.

(51) Int. Cl.

| | |
|---|---|
| ***A61K 39/395*** | (2006.01) |
| ***A61K 39/00*** | (2006.01) |
| ***A61K 40/11*** | (2025.01) |
| ***A61K 40/31*** | (2025.01) |
| ***A61K 40/32*** | (2025.01) |
| ***A61K 40/42*** | (2025.01) |
| ***A61P 35/00*** | (2006.01) |

(52) U.S. Cl.

CPC ........ *A61K 39/39541* (2013.01); *A61K 40/11* (2025.01); *A61K 40/31* (2025.01); *A61K 40/32* (2025.01); *A61K 40/42* (2025.01); *A61K 40/4202* (2025.01); *A61K 40/4211* (2025.01); *A61K 40/4215* (2025.01); *A61K 40/4257* (2025.01); *A61K 40/4265* (2025.01); *A61K 40/4269* (2025.01); *A61K 40/4274* (2025.01); *A61P 35/00* (2018.01); *A61K 2039/505* (2013.01); *A61K 2239/28* (2023.05); *A61K 2239/31* (2023.05); *A61K 2239/38* (2023.05); *A61K 2239/48* (2023.05); *A61K 2239/50* (2023.05)

(58) Field of Classification Search

CPC .............. A61K 35/17; A61K 39/39541; A61K 2039/505; A61K 38/19; A61K 48/005; A61K 2239/31; A61K 2239/38; A61K 2239/48; A61K 39/4611; A61K 39/4631; A61K 39/4632; A61K 39/464402; A61K 39/464412; A61K 39/464417; A61K 39/46447; A61K 39/464481; A61K 39/464488; A61K 2239/28; A61K 2239/50; A61K 39/4644; A61K 39/464493; A61K 2300/00; A61P 35/00; C07K 16/2809; C07K 16/40; C07K 2317/24; C07K 2317/31; C07K 2317/622; C07K 16/28; C07K 16/2803; C07K 16/3092; C12N 2740/16043

See application file for complete search history.

(56) References Cited

U.S. PATENT DOCUMENTS

| | | | |
|---|---|---|---|
| 9,388,237 | B2 | 7/2016 | Govindan |
| 9,572,837 | B2 | 2/2017 | Wu |
| 9,932,405 | B2 | 4/2018 | Xiao et al. |

(Continued)

FOREIGN PATENT DOCUMENTS

| | | | |
|---|---|---|---|
| EP | 2508176 | A1 | 10/2012 |
| JP | 2016500659 | A1 | 1/2016 |

(Continued)

OTHER PUBLICATIONS

Kim, S. et al, Increased IL-12 Inhibits B Cells' Differentiation to Germinal Center Cells and Promotes Differentiation to Short-Lived Plasmablasts, J Exp Med, 205(10):2437-2448, Sep. 22, 2008 (Year: 2008).*

(Continued)

*Primary Examiner* — Daniel C Gamett
(74) *Attorney, Agent, or Firm* — Lee & Hayes, P.C.

(57) ABSTRACT

The present disclosure relates to compositions and methods for enhancing T cell response and/or CAR cell expansion and/or maintenance in vivo and/or in vitro. For example, in a method of in vivo cell expansion, the method comprises administering an effective amount of cells comprising an antigen binding molecule to a subject; and administering an effective amount of presenting cells expressing a solid tumor antigen that the binding molecule binds.

21 Claims, 106 Drawing Sheets

Specification includes a Sequence Listing.

(56) References Cited

U.S. PATENT DOCUMENTS

| | | | |
|---|---|---|---|
| 10,561,686 | B2 * | 2/2020 | Xiao .................... A61K 38/177 |
| 10,869,888 | B2 * | 12/2020 | Xiao ................ A61K 39/00117 |
| 2002/0052027 | A1 | 5/2002 | Chen et al. |
| 2002/0192183 | A1 | 12/2002 | Jensen |
| 2005/0079170 | A1 | 4/2005 | Le Gall et al. |
| 2011/0110936 | A1 | 5/2011 | Nam et al. |
| 2013/0108609 | A1 | 5/2013 | Vihko |
| 2013/0287748 | A1 | 10/2013 | June et al. |
| 2014/0050708 | A1 | 2/2014 | Powell et al. |
| 2014/0227237 | A1 | 8/2014 | June et al. |
| 2014/0248278 | A1 | 9/2014 | Tuscano et al. |
| 2014/0271635 | A1 | 9/2014 | Brogdon et al. |
| 2015/0037356 | A1 | 2/2015 | Elvin et al. |
| 2015/0038684 | A1 | 2/2015 | Jensen |
| 2015/0329640 | A1 | 11/2015 | Finer |
| 2015/0337369 | A1 | 11/2015 | Davis et al. |
| 2016/0008398 | A1 | 1/2016 | Sadelain et al. |
| 2016/0024175 | A1 | 1/2016 | Chow et al. |
| 2016/0250258 | A1 | 9/2016 | Delaney et al. |
| 2016/0256488 | A1 | 9/2016 | Wu |
| 2016/0289293 | A1 | 10/2016 | Pule et al. |
| 2016/0362472 | A1 | 12/2016 | Bitter et al. |
| 2017/0015746 | A1 | 1/2017 | Jensen |
| 2017/0096638 | A1 | 4/2017 | Wu |
| 2017/0136063 | A1 | 5/2017 | Perez et al. |
| 2017/0137783 | A1 | 5/2017 | Bedoya et al. |
| 2017/0145094 | A1 | 5/2017 | Galetto |
| 2017/0145108 | A1 | 5/2017 | Schreiber et al. |
| 2017/0209492 | A1 | 7/2017 | June et al. |
| 2017/0218337 | A1 | 8/2017 | Friedman |
| 2017/0224798 | A1 | 8/2017 | Cooper et al. |
| 2017/0319638 | A1 | 11/2017 | Conner et al. |
| 2017/0335281 | A1 | 11/2017 | Loew et al. |
| 2017/0355776 | A1 | 12/2017 | Xiao et al. |
| 2017/0362325 | A1 | 12/2017 | Jung et al. |
| 2017/0368098 | A1 | 12/2017 | Chen et al. |
| 2018/0028631 | A1 | 2/2018 | Chen |
| 2018/0044424 | A1 | 2/2018 | June et al. |
| 2018/0153977 | A1 | 6/2018 | Wu et al. |
| 2018/0179289 | A1 | 6/2018 | Xiao et al. |
| 2018/0222995 | A1 | 8/2018 | Xiao et al. |
| 2018/0223255 | A1 | 8/2018 | Wu et al. |
| 2018/0230429 | A1 | 8/2018 | Baeuerle et al. |
| 2018/0243340 | A1 | 8/2018 | Varadarajan et al. |
| 2018/0334490 | A1 | 11/2018 | Brogdon et al. |
| 2018/0346876 | A1 | 12/2018 | Xiao et al. |
| 2019/0000878 | A1 | 1/2019 | Xiao et al. |
| 2019/0185817 | A1 | 6/2019 | Melton et al. |
| 2019/0216851 | A1 | 7/2019 | Xiao et al. |
| 2019/0314410 | A1 | 10/2019 | Rossi et al. |
| 2019/0314411 | A1 | 10/2019 | Xiao et al. |
| 2020/0155598 | A1 | 5/2020 | Xiao et al. |
| 2021/0060069 | A1 * | 3/2021 | Xiao .................... A61K 38/208 |
| 2021/0077532 | A1 | 3/2021 | Xiao et al. |
| 2021/0100841 | A1 | 4/2021 | Xiao et al. |
| 2021/0137983 | A1 * | 5/2021 | Xiao .................. C07K 14/5412 |
| 2021/0161961 | A1 | 6/2021 | Xiao et al. |
| 2021/0230308 | A1 | 7/2021 | Xiao et al. |
| 2021/0252059 | A1 | 8/2021 | Pu et al. |
| 2021/0379149 | A1 * | 12/2021 | Pu .......................... A61K 35/17 |
| 2022/0000921 | A1 | 1/2022 | Xiao et al. |
| 2022/0056092 | A1 | 2/2022 | Ols et al. |
| 2022/0064599 | A1 | 3/2022 | Spanholtz et al. |
| 2022/0096546 | A1 | 3/2022 | Xiao et al. |
| 2022/0105134 | A1 * | 4/2022 | Cao ......................... A61P 35/00 |
| 2022/0195009 | A1 | 6/2022 | Arnold et al. |
| 2022/0339193 | A1 | 10/2022 | Xiao et al. |
| 2022/0348682 | A1 | 11/2022 | Xiao et al. |
| 2023/0312677 | A1 | 10/2023 | Posey et al. |

FOREIGN PATENT DOCUMENTS

| | | | | |
|---|---|---|---|---|
| JP | 2018508539 | A | | 3/2018 |
| JP | 2018518939 | A | | 7/2018 |
| JP | 2018528774 | A | | 10/2018 |
| JP | 2021510540 | A | | 4/2021 |
| JP | 2022507830 | A | | 1/2022 |
| NO | 168969 | B | | 1/1992 |
| WO | WO8303679 | A1 | | 10/1983 |
| WO | WO2001036001 | A2 | | 5/2001 |
| WO | WO2008131445 | A1 | | 10/2008 |
| WO | WO2010081738 | A1 | | 7/2010 |
| WO | WO2010126766 | A1 | | 11/2010 |
| WO | WO2011130566 | A2 | | 10/2011 |
| WO | WO2012050374 | A1 | | 4/2012 |
| WO | WO2012066495 | A2 | | 5/2012 |
| WO | WO2012079000 | A1 | | 6/2012 |
| WO | WO2013123061 | A1 | | 8/2013 |
| WO | WO2014011984 | A1 | | 1/2014 |
| WO | WO2014011988 | A2 | | 1/2014 |
| WO | WO2014012001 | A2 | | 1/2014 |
| WO | WO2014031687 | A1 | | 2/2014 |
| WO | WO2014130657 | A1 | | 8/2014 |
| WO | WO2014134165 | A1 | | 9/2014 |
| WO | WO2015105522 | A1 | | 7/2015 |
| WO | WO2015142675 | A2 | | 9/2015 |
| WO | WO2015157252 | A1 | | 10/2015 |
| WO | WO2015157384 | A1 | | 10/2015 |
| WO | WO2015157432 | A1 | | 10/2015 |
| WO | WO2015188141 | A2 | | 12/2015 |
| WO | WO2016014565 | A2 | | 1/2016 |
| WO | WO2016028896 | A1 | | 2/2016 |
| WO | WO2016061574 | A1 | | 4/2016 |
| WO | WO2016064899 | A1 | | 4/2016 |
| WO | WO2016-070136 | A1 | | 5/2016 |
| WO | WO2016090034 | A2 | | 6/2016 |
| WO | WO2016090190 | A1 | | 6/2016 |
| WO | WO2016113203 | A1 | | 7/2016 |
| WO | WO2016164731 | A2 | | 10/2016 |
| WO | WO2016174652 | A1 | | 11/2016 |
| WO | WO2016210293 | A1 | | 12/2016 |
| WO | WO2017011804 | A1 | | 1/2017 |
| WO | WO2017027291 | A1 | | 2/2017 |
| WO | WO2017044487 | A1 | | 3/2017 |
| WO | WO2017050884 | A1 | | 3/2017 |
| WO | WO2017075537 | A1 | | 5/2017 |
| WO | WO2017120525 | A1 | | 7/2017 |
| WO | WO2017123556 | A1 | | 7/2017 |
| WO | WO2017040324 | A1 | | 9/2017 |
| WO | WO2017149515 | A1 | | 9/2017 |
| WO | WO2017167217 | A1 | | 10/2017 |
| WO | WO2017172952 | A1 | | 10/2017 |
| WO | WO2017172981 | A1 | | 10/2017 |
| WO | WO2017173403 | A1 | | 10/2017 |
| WO | WO2017177137 | A1 | | 10/2017 |
| WO | WO2017210617 | A2 | | 12/2017 |
| WO | WO2018013918 | A1 | | 1/2018 |
| WO | WO2018018958 | A1 | | 2/2018 |
| WO | WO2018023976 | A1 | | 2/2018 |
| WO | WO2018026819 | A2 | | 2/2018 |
| WO | WO2018027155 | A1 | | 2/2018 |
| WO | WO2018049418 | A1 | | 3/2018 |
| WO | WO2018067697 | A1 | | 4/2018 |
| WO | WO2018106732 | A1 | | 6/2018 |
| WO | WO2018108106 | A1 | | 6/2018 |
| WO | WO2018111763 | A1 | | 6/2018 |
| WO | WO2018144535 | A1 | | 8/2018 |
| WO | WO2018156802 | A1 | | 8/2018 |
| WO | WO2018191748 | A1 | | 10/2018 |
| WO | WO2018193231 | A1 | | 10/2018 |
| WO | WO2019091478 | A1 | | 5/2019 |
| WO | WO-2019136305 | A1 | * | 7/2019 |
| WO | WO2019140100 | A1 | | 7/2019 |
| WO | WO2019157533 | A1 | | 8/2019 |
| WO | WO2019178576 | A1 | | 9/2019 |
| WO | WO2020047306 | A1 | | 3/2020 |
| WO | WO2020086742 | A1 | | 4/2020 |
| WO | WO2020086989 | A1 | | 4/2020 |
| WO | WO2020088631 | A1 | | 5/2020 |
| WO | WO2020106843 | A1 | | 5/2020 |
| WO | WO2020108642 | A1 | | 6/2020 |
| WO | WO2020108643 | A1 | | 6/2020 |
| WO | WO2020108644 | A1 | | 6/2020 |

(56) References Cited

FOREIGN PATENT DOCUMENTS

| | | |
|---|---|---|
| WO | WO2020108645 A1 | 6/2020 |
| WO | WO2020108646 A1 | 6/2020 |
| WO | WO2020146743 A1 | 7/2020 |

OTHER PUBLICATIONS

Largeot A. et al, The B-Side of Cancer Immunity: The Underrated Tune, Cells 8(5), 449, May 13, 2019 (Year: 2019).*
Ghadially H. et al, Differential Regulation of CCL22 Gene Expression in Murine Dendritic Cells and B Cells, J Immunol, 174(9):5620-5629, 2005 (Year: 2005).*
European Office Action mailed Mar. 17, 2022 for European Patent Application No. 19700326.2, a foreign counterpart to U.S. Pat. No. 10,561,686, 7 pages.
Partial European Search Report mailed May 4, 2022 for European Patent Application No. 19854895.0, 13 pages.
Japanese office action mailed Apr. 5, 2022 in Japanese Application No. 2021-512204, a foreign corresponding application of U.S. Appl. No. 17/220,387, 10 pages. Translated.
Marks et al., "By-passing Immunization: Human Antibodies from V-gene Libraries Displayed on Phage" 1991. Journal of Molecular Biology, 222(3): 581-597.
U.S. Appl. No. 16/961,418, filed Jul. 10, 2020, Pending.
U.S. Appl. No. 17/749,824, filed May 20, 2022, Pending.
U.S. Appl. No. 17/420,066, filed Jun. 30, 2021, US 2022/0096546, Pending.
U.S. Appl. No. 17/270,571, filed Feb. 23, 2021, Pending.
Brischwein et al. "Strictly target cell-dependent activation of T cells by bispecific single-chain antibody constructs of the BiTE class" J Immunother, Nov. 2007, vol. 30, pp. 798-807.
Chmielewski, "Of CARs and TRUCKs: Chimeric antigen receptor (CAR) T Cells Engineered with an Inducible Cytokine to Modulate the Tumor Stroma," Jan. 2014. Imunological Reviews, 257(1): 83-90.
European Search Report mailed Aug. 31, 2021 in European Application No. 21275039.2, a foreign corresponding application of U.S. Appl. No. 16/999,357, 13 pages.
Huang et al., "Interleukin-armed Chimeric Antigen Receptor-modified T Cells for Cancer Immunotherapy," Sep. 2017. Gene Thereapy, 25(3):192-197.
International Preliminary Report on Patentability dated Jul. 22, 2021 in PCT Application No. PCT/US2020/013099, 9 pages.
International Search Report & Written Opinion mailed Aug. 13, 2021 from PCT Application No. PCT/2021/028429, 12 pages.
Lee et al., "Use of a Simgle CAR T Cell and Several Bispecific Adapters Facilitates Eradication of Multiple Antigenically Differeent Solid Tumors," Nov. 2018. Cancer Research, 79(2): 387-396.
Wong et al. "Blinatumomab induces autologous T-cell killing of chronic lymphocytic leukemia cells," Jun. 2013, Haematologica, vol. 98(12): 1930-1938.
"Anti-ACPP Product Datasheet", Atlas Antibodies, retrieved on Oct. 31, 2019 from https://www.atlasantibodies.com/api/print_datasheet/HPA004335.pdf, Dec. 2012 1 page.
"Anti-UPK2 Product Datasheet", Atlas Antibodies, retrieved on Oct. 31, 2019 from https://www.atlasantibodies.com/api/print_datasheet/HPA061106.pdf, Dec. 2012, 1 page.
Invitation to Pay Additional Fees mailed on Nov. 13, 2019 for PCT Application PCT/US19/48890, 3 Pages.
International Preliminary Report on Patentability mailed Mar. 11, 2021 for PCT Application No. PCT/US19/48890, 8 pages.
International Search Report and Written Opinion mailed on Feb. 7, 2020 for PCT Application No. PCT/US19/48890, 15 pages.
Chen, et al., "CAR T-cell intrinsic PD-1 checkpoint blockade: a two-in-one approach for solid tumor immunotherapy," Feb. 2017, OncoImmunology, 6:2, e1273302, DOI: 10.1080/2162402X.2016.1273302. 4 pages.
Extended European Search Report mailed Nov. 25, 2019 in EP Application No. 19180127.3, Xiao et al., a corresponding foreign application of U.S. Appl. No. 16/146,218, 11 pages.
Fang et al., "Stable antibody expression at therapeutic levels using the 2A peptide," May 2005, Nature Biotechnology. 23(5):584-590.
PCT Communication Invitation to Pay Fees mailed Mar. 30, 2020 for PCT Application No. PCT/US20/13099, "Modified Cell Expansion and Uses Thereof", 2 pages.
Jernberg-Wiklund, et al., "Recombinant interferon-gamma inhibits the growth of IL-6-dependent human multiple myeloma cell lines in vitro," 1991. Eur J Haematol, 46:231.239.
Lee et al., "T cells expressing CD19 chimeric antigen receptors for acute lymphoblastic leukemia in children and young adults: a phase 1 dose-escalation trial," Oct. 2014. The Lancet, 385(9967): 517-528.
Maude et al., "Chimeric antigen receptor T cells for sustained remissions in leukemia," Oct. 2014. N Engl J Med. 371(16): 1507-1517.
Milone, et al., "Chimeric receptors containing CD137 signal transduction domains mediate enhanced survival of T cells and increased antileukemic efficacy in vivo," Apr. 2009. Molecular Therapy, 17(8): 1453-1464.
Partial European Search Report mailed Nov. 4, 2019 in EP Application No. 19180127.3, Xiao et al., a corresponding foreign application of U.S. Appl. No. 16/146,218, 18 pages.
PCT Search Report and Written Opinion mailed on Jun. 17, 2019 for PCT Application No. PCT/US19/13068, 14 pages.
PCT Search Report and Written Opinion mailed on Jun. 4, 2020 for PCT Application No. PCT/US2020/013099, 13 pages.
Qin et al., "Incorporation of a hinge domain improves the expansion of chimeric antigen receptor T cells," 2017, Journal of Hematology & Oncology, 10:68, 11 pages.
Sahm et al., "Expression of IL-15 in NK Cells Results in Rapid Enrichment and Selective Cytotoxicity of Gene-Modified Effectors That Carry a Tumor-Specific Antigen Receptor," Sep. 2012, Cancer Immunol Immunother, 61(9): 1451-1461.
Supplemental European Search Report mailed Jan. 13, 2020 in EP Application No. 19700326, Xiao et al., a corresponding foreign application of U.S. Appl. No. 16/146,218, 7 pages.
Takahashi, et al., "Expression of MUC1 on myeloma cells and induction of HJLA-unrestricted CTL against MUC1 from a multiple myeloma patient," 1994. J Immunol, 153:2102-2109.
Wilkie, et al. "Retargeting of human T cells to tumor-associated MUC1: The evolution of a chimeric antigen receptor," 2008, J. Immunol., 180:4901-4909.
Xiao et al., "Pre-clinical experiments of cart cells identifying tshr as a potential target against metastatic thyroid cancer," May 2018. Database EMBASE [Online] Elsevier Science Publishers, Database Accession No. EMB-623339571, 1 page.
You et al., "Phase 1 clinical trial demonstrated that MUC1 positive metastatic seminal vesicle cancer can be effectively eradicated y modified Anti-MUC1 chimeric antigen receptor transduced T cells", Apr. 2016, Science China: Life Sciences, 59(4): 386-397.
Canadian Office Action for Canadian Patent Appl.: 3,088,161, mailed Sep. 22, 2021, a foreign corresponding application of U.S. Appl. No. 16/999,357, 4 pages.
U.S. Appl. No. 16/146,218, filed Sep. 28, 2018, US-2019-0216851-A1, U.S. Pat. No. 10,561,686, Issued.
U.S. Appl. No. 16/445,965, filed Jun. 19, 2019, US-2020-0155598-A1, Allowed.
U.S. Appl. No. 17/144,800, filed Jan. 8, 2021, Pending.
U.S. Appl. No. 16/387,166, filed Apr. 17, 2019, US 2019-0314411 A1, U.S. Pat. No. 10,869,888, Issued.
U.S. Appl. No. 17/108,076, filed Dec. 1, 2020, Pending.
U.S. Appl. No. 17/091,741, filed Nov. 6, 2020, Pending.
U.S. Appl. No. 16/996,237, filed Aug. 18, 2020, Pending.
U.S. Appl. No. 16/999,357, filed Aug. 21, 2020, Pending.
U.S. Appl. No. 17/173,504, filed Feb. 11, 2021, Pending.
Rizzardi, et al., "Evaluation of Protein Biomarkers of Prostate Cancer Aggressiveness," Dec. 2014. BMC Cancer, 14(1): 14 pgs.
U.S. Appl. No. 16/146,218, filed Sep. 28, 2018, US-2019-0216851-A1, U.S. Pat. No. 10,561,686, Granted.

(56) References Cited

OTHER PUBLICATIONS

U.S. Appl. No. 16/961,418, filed Jul. 10, 2020, US 2022-0265708 A1, Pending.
U.S. Appl. No. 16/445,965, filed Jun. 19, 2019, US-2020-0155598-A1, U.S. Pat. No. 10,918,667, Granted.
U.S. Appl. No. 17/144,800, filed Jan. 8, 2021, US 2021-0161961 A1, Pending.
U.S. Appl. No. 17/295,364, filed May 19, 2021, US 2022-0000921 A1, Pending.
U.S. Appl. No. 17/749,824, filed May 20, 2022, US-2022-0339193 A1, Pending.
U.S. Appl. No. 16/387,166, filed Apr. 17, 2019, US 2019-0314411 A1, U.S. Pat. No. 10,869,888, Granted.
U.S. Appl. No. 17/091,741, filed Nov. 6, 2020, US 2021-0137983 A1, Pending.
U.S. Appl. No. 17/108,076, filed Dec. 1, 2020, US 2021-0077532 A1, Pending.
U.S. Appl. No. 17/420,066, filed Jun. 30, 2021, US 2022/0096546 A1, Pending.
U.S. Appl. No. 17/270,571, filed Feb. 23, 2021, US 2022-0348682 A1, Pending.
U.S. Appl. No. 17/220,387, filed Apr. 1, 2021, US 2021-0230308 A1, U.S. Pat. No. 11,161,913, Granted.
U.S. Appl. No. 17/123,732, filed Dec. 16, 2020, Pending.
U.S. Appl. No. 17/173,504, filed Feb. 11, 2021, US 2021-0252059 A1, Pending.
U.S. Appl. No. 17/996,589, filed Oct. 19, 2022, Pending.
U.S. Appl. No. 16/996,237, filed Aug. 18, 2020, US 2021-0060069 A1, Pending.
U.S. Appl. No. 17/331,289, filed May 26, 2021, US 2021-0371492 A1, Pending.
U.S. Appl. No. 16/999,357, filed Aug. 21, 2020, US 2021-0100841 A1, Pending.
Anderson, et al. "Obstacles Posed by the Tumor Microenvironment to T Cell Activity: A Case for Synergistic Therapies," Cancer Cell, vol. 31, No. 3, Mar. 2017, pp. 311-325.
Examination Report for Australian Application No. 2019384145, Dated Aug. 5, 2024, 4 pages.
Bollino et al., "Chimeric Antigen Receptor-Engineered Natural Killer and Natural Killer T cells for Cancer Immunotherapy," Translational Research, Jun. 2017, 187:32-43.
Extended European Search Report mailed Jun. 11, 2024 for European Patent Application No. 21792367.1, 13 pages.
Fang et al., "NK Cell-based Immunotherapy for Cancer," Seminars in Immunology, Aug. 2017, 31:37-54.
PCT Search Report and Written Opinion mailed on Feb. 20, 2020 for PCT Application No. PCT/US19/62417, 14 pages.
Office Action for Japanese Application No. 2021-540137, Dated Jul. 30, 2024, 6 pages.
Koneru, et al., "A Phase I Clinical Trial of Adoptive T Cell Therapy Using IL-12 Secreting MUC-16(Ecto) Directed Chimeric Antigen Receptors for Recurrent Ovarian Cancer," Journal of Translational Medicine, vol. 13, No. 102, Mar. 2015, 11 pages.
Kong, et al., "Emerging Roles of Human Prostatic Acid Phosphatase" Biomolecules & Therapeutics, vol. 21, No. 1, 2013, pp. 10-20.
Lu, et al., "Generation of Murine Induced Pluripotent Stem Cells by Using High-Density Distributed Electrodes Network," Biomicrofluidics, vol. 9, No. 5, Sep. 2015, pp. 054107-1-054107-11.
Oladapo, et al., "Armored CART-Cells: Utilizing Cytokines and Pro-Inflammatory Ligands to Enhance CAR T-Cell Anti-Tumour Efficacy," Biochemical Society Transactions, vol. 44, Part 2, Apr. 2016, pp. 412-418.
Sarvaria et al., "B cell Regulation in Cancer and Anti-Tumor Immunity", Cellular and Molecular Immunology, Aug. 2017, 14:662-674.
Bork, P., "Powers and Pitfalls in Sequence Analysis: The 70% Hurdle," Genome Research, 2000, 10:398-400.
Bowie et al., "Deciphering the Message in Protein Sequences: Tolerance to Amino Acid Substitutions," Science, Mar. 1990, 247:1306-1310.
Burgess et al., "Possible Dissociation of the Heparin-binding and Mitogenic Activities of Heparin-binding (Acidic Fibroblast) Growth Factor-1 from its Receptor-binding Activities by Site-directed Mutagenesis of a Single Lysine Residue," J. Cell Biol., Nov. 1990, 111:2129-2138.
Duong et al., "Bacteria-cancer Interactions: Bacteria-based Cancer Therapy," Experimental & Molecular Medicine, 2019, 51:152, 15 pages.
Japanese Office Action mailed May 30, 2023 for Japanese Patent Application No. 2020-558861, a foreign counterpart to U.S. Pat. No. 10,561,686, 7 pages.
Lazar et al., "Transforming Growth Factor Alpha: Mutation of Aspartic Acid 47 and Leucine 48 Results in Different Biological Activities," Mol. Cell. Biol., Mar. 1988, 8(3):1247-1252.
Mirzaei et al., "Chimeric Antigen Receptors T Cell Therapy in Solid Tumor: Challenges and Clinical Applications," Fronteirs in Immunology, Dec. 2017, 8:1850, 13 pages.
Singapore Office action mailed Feb. 28, 2023, in Singapore Application No. 11202107269X, a corresponding foreign application of U.S. Appl. No. 16/387,166, 12 pages.
Turtle et al., "Immunotherapy of Non-Hodgkin's Lymphoma with a Defined Ratio of CD8+ and CD4+ CD19-specific Chimeric Antigen Receptor-modified T cells," Science Translational Medicine, Sep. 2016, 8:355, 29 pages.
Zhou et al., "The Use of tMUC1 Highly Specific Chimeric Antigen Receptor-redirected T cells for the Eradication of Triple Negative Breast Cancer," J Immunol, May 2017, 198 (1 Supplement):198.10, 2 pages, Abstract.
Sarvaria et al., "B cell Regulation in Cancer and Anti-Tumor Immunity", Cellular and Molecular Immunology, Apr. 2017, 14:662-674.
Cherkassky et al., "Human CAR T Cells with Cell-intrinsic PD-1 Checkpoint Blockade Resist Tumor-mediated Inhibition," Journal of Clinical Investigation, May 2016, 126(8):3130-3144.
Chmielewski et al., "CAR T Cells Releasing IL-18 Convert to T-Bethigh FoxO1low Effectors that Exhibit Augmented Activity Against Solid Tumors," Cell Reports, Dec. 2017, 21:3205-3219.
Eyquem et al., "Targeting a CAR to the TRAC Locus with CRISPR/Cas9 Enhances Tumour Rejection," Nature, Mar. 2017, 543:113-117.
Grada et al., "TanCar: A Novel Bispecific Chimeric Antigen Receptor for Cancer Immunotherapy," Molecular Therapy- Nucleic Acids, Jul. 2013, vol. 2:e105, 11 pages.
Liu et al., "A Chimeric Switch-receptor Targeting PD1 Augments the Efficacy of Second-Generation CAR T Cells in Advanced Solid Tumors," Cancer Research, Mar. 2016, 76(6):1578-1590.
Magee et al., "GUCY2C-directed CAR-T Cells Oppose Colorectal Cancer Metastases Without Autoimmunity," OncoImmunology, Oct. 2016, 5(1):e1227897, 11 pages.
Roybal et al., "Engineering T cells with Customized Therapeutic Response Programs Using Synthetic Notch Receptors," Cell, Oct. 2016, 167:419-432.
Almagro et al., "Progress and challenges in the design and clinical development of antibodies for cancer therapy," Frontiers in Immunology, Jan. 2018, 8:1751, 19 pages.
Breloer et al., "CD83 Regulates Lymphocyte Maturation, Activation and Homeostasis," Trends in Immunology, Mar. 2008, 29(4):186-194.
Brown et al., "Tolerance of Single, But Not Multiple, Amino Acid Replacements in Antibody VH CDR 2: A Means of Minimizing B Cell Wastage from Somatic Hypermutation?" Journal of Immunology, May 1996, 156(9):3285-3291.
Brudno et al., "Toxicities of Chimeric Antigen Receptor T Cells: Recognition and Management," Blood, Jun. 2016, 127(26):3321-3330.
Cho et al., "Triple Costimulation Via CD80, 4-1BB, and CD83 Ligand Elicits the Long-Term Growth of Vγ9Vδ2 T Cells in Low Levels of IL-2," Journal of Leukocyte Biology, Apr. 2016, 99(4):521-529.
Du et al., "Granulocyte Colony-Stimulating Factor Treatment During Radiotherapy is Associated With Survival Benefit in Patients With Lung Cancer," Technology in Cancer Research & Treatment, Dec. 2018, 17:1-7.

(56) References Cited

OTHER PUBLICATIONS

European Office Action mailed Feb. 5, 2024 for European Application No. 19854895.0, a foreign counterpart to U.S. Appl. No. 17/270,571, 6 pages.
Japanese Office Action mailed Jan. 30, 2024 for Japanese Application No. 2021-540137, a foreign counterpart to U.S. Appl. No. 17/420,066, 7 pages.
Konjevic et al., "The Role of Cytokines in the Regulation of NK Cells in the Tumor Environment," Cytokine, May 2019, 117:30-40.
Li et al., "CD83: Activation Marker for Antigen Presenting Cells and Its Therapeutic Potential," Frontiers in Immunology, Jun. 2019, 10:Article 1312, 9 pages.
Priceman et al., "Co-stimulatory Signaling Determines Tumor Antigen Sensitivity and Persistence of CAR T Cells Targeting PSCA+ Metastatic Prostate Cancer," OncoImmunology, Feb. 2018, 7(2):e1380764, 13 pages.
Rabinowich et al., "Response of Human NK Cells to IL-6 Alterations of the Cell Surface Phenotype, Adhesion to Fibronectin and Laminin, and Tumor Necrosis Factor-Alpha/Beta Secretion," Journal of immunology, Jun. 1993, 150 (11):4844-4855.
Scheuermann et al., "CD19 Antigen in Leukemia and Lymphoma Diagnosis and Immunotherapy," Leukemia & Lymphoma, 1995, 18(5-6):385-397.
Su et al., "Interleukin-7 Expression and its Effect on Natural Killer Cells in Patients with Multiple Sclerosis," J Neuroimmunol., Nov. 2014, 276(0):180-186.
Zhang et al., "The Emerging World of TCR-T Cell Trials Against Cancer: A Systematic Review," Technology in Cancer Research & Treatment, Jul. 2019, 18:1-13.
Canadian Office Action mailed Jul. 20, 2022 for Canadian Patent Application No. 3,088,161, a foreign counterpart to U.S. Pat. No. 10,561,686, 4 pages.
Chmielewski, et al., "IL-12 Release by Engineered T Cells Expressing Chimeric Antigen Receptors Can Effectively Muster and Antigen-Independent Macrophage Response on Tumor Cells That Have Shut Down Tumor Antigen Expression", Cancer Research, Jul. 2011, 71(17):5697-5706.
Extended European Search Report mailed Nov. 14, 2022 for European Patent Application No. 19887928.0, a foreign corresponding application of U.S. Appl. No. 16/445,965, 12 pages.
Extended European Search Report mailed Nov. 24, 2022 for European Patent Application No. 20739064.2, a foreign corresponding application of U.S. Appl. No. 16/387,166, 13 pages.
European Search Report mailed Aug. 4, 2022 in European Application No. 19854895.0, a foreign corresponding application of U.S. Appl. No. 17/270,571, 8 pages.
Hoyos, et al., "Engineering CD19-specific T lymphocytes with interleukin-15 and a suicide gene to enhance their anti-lymphoma/leukemia effects and safety", Leukemia, Apr. 2010, 24(6):1160-1170.
Japanese Office Action mailed Sep. 20, 2022 for Japanese Patent Application No. 2020-558861, a foreign counterpart to U.S. Pat. No. 10,561,686, 7 pages.
Klaver, et al., "Plasma IFN-[gamma] and IL-6 levels correlate with peripheral T-cell numbers but not toxicity in RCC patients treated with CAR T-cells", Clinical Immunology, Jul. 2016, 169:107-113.
Koneru, et al., "IL-12 Secreting tumor-targeted chimeric antigen receptor T cells eradicate ovarian tumors in vivo", Oncoimmunology, Jan. 2015, 4(3):e994446, 11 pages.
Posey et al., "Engineered CAR T Cells Targeting the Cancer-Associated Tn-Glycoform of the Membrane Mucin MUC1 Control Adenocarcinoma", Immunity, Jun. 2016, 44(6):1444-1454.
Leon-Triana, et al., "Dual-Target CAR-Ts with On- and Off-Tumor Activity May Override Immune Suppression in Solid Cancers: A Mathematical Proof of Concept", Cancers, Feb. 2021, 13(4):703, 20 pages.
Trinchieri, "Interleukin-12 and the regulation of innate resistance and adaptive immunity", Nature Reviews Immunology. Feb. 2003, 3(2):133-146.
Canadian Office Action mailed Sep. 1, 2023 for Canadian Patent Application No. 3,125,646, a foreign counterpart to U.S. Pat. No. 10,869,888, 4 pages.
Office Action for European Application No. 21275039.2, Dated May 23, 2024, 7 pages.
Office Action for Japanese Application No. 2021-527959, Dated May 7, 2024, 6 pages.
Kim, et al., "High Cleavage Efficiency of a 2A Peptide Derived from Porcine Teschovirus-1 in Human Cell Lines, Zebrafish and Mice", PLoS One, vol. 6, issue 4, Apr. 29, 2011, pp. 1-8.
Altuntas et al., "Autoimmunity to Uroplakin II Causes Cystitis in Mice: A Novel Model of Interstitial Cystitis," Eur Urol, Jan. 2012, 61(1):193-200.
Auerbach et al., "Angiogenesis Assays: Problems and Pitfalls," Cancer and Metastasis Reviews, Jun. 2000, 19:167-172.
Beans, "Targeting Metastasis to Halt Cancer's Spread," PNAS, Dec. 2018, 115(50):12539-12543.
Canadian Office Action mailed Sep. 14, 2023 for Canadian Application No. 3120153, a foreign corresponding application of U.S. Appl. No. 17/295,364, 4 pages.
Canadian Office Action mailed Sep. 19, 2023 for Canadian Application No. 3110096, a foreign corresponding application of U.S. Appl. No. 17/270,571, 3 pages.
Gravanis et al., "The Changing World of Cancer Drug Development: The Regulatory Bodies' Perspective," Chinese Clinical Oncology, May 2014, 3(2):22, 5 pages.
Gura, "Systems for Identifying New Drugs Are Often Faulty," Science, Nov. 1997, 278(5340):1041-1042.
Hait, "Anticancer Drug Development: The Grand Challenges," Nature Reviews/Drug Discovery, Apr. 2010, 9:253-254.
Heppner et al., "Tumor Heterogeneity: Biological Implications and Therapeutic Consequences," Cancer Metastasis Review 1983, 2:5-23.
Hoang et al., "A Newly Developed Uroplakin II Antibody With Increased Sensitivity in Urothelial Carcinoma of the Bladder," Arch Pathol Lab Med, Jul. 2014, 138:943-949.
Jain, "Barriers to Drug Delivery in Solid Tumors," Scientific American, Jul. 1994, 271(1):58-65.
Japanese Office Action mailed Oct. 17, 2023 for Japanese Application No. 2021-527959, a foreign corresponding application of U.S. Appl. No. 17/295,364, 6 pages.
Japanese Office Action mailed Oct. 31, 2023 for Japanese Application No. 2022-154638, aa foreign corresponding application of U.S. Appl. No. 17/270,571, 6 pages.
Liou et al., "Macrophage-secreted Cytokines Drive Pancreatic Acinar-to-ductal Metaplasia Through NF-KB and MMPs," Journal of Cell Biology, 2013, 202(3):563-577.
Mishu et al., "Effects of Recombinant Canine Granulocyte Colony-stimulating Factor on White Blood Cell Production in Clinically Normal and Neutropenic Dogs," J Am Vet Med Assoc., Jun. 1992, 200(12), Abstract, 1 page.
Ping et al., "T-cell Receptor-engineered T Cells for Cancer Treatment: Current Status and Future Directions," Protein Cell, Mar. 2018, 9(3):254-266.
Rahman et al., "Histology, Natural Killer Cells," retrieved from <<https://www.ncbi.nlm.nih.gov/books/NBK565844/>>, StatPearls Publishing, Feb. 2023, 6 pages.
Rohaan et al., "Adoptive Cellular Therapies: The Current Landscape," Virchows Archiv, Nov. 2018, 474:449-461.
Snook et al., "GUCY2C-targeted Cancer Immunotherapy: Past, Present and Future," Immunology Research, Dec. 2011, 51:161-169.
Sporn et al., "Chemoprevention of Cancer", Carcinogenesis, Mar. 2000, 21(3):525-530.
Tigner et al., "Histology, White Blood Cell," retrieved from <<https://www.ncbi.nlm.nih.gov/books/NBK563148/>>, StatPearls Publishing, Nov. 2022, 5 pages.
Wu et al., "Potentiating Antilymphoma Efficacy of Chemotherapy Using a Liposome for Integration of CD20 Targeting, Ultra-violet Irradiation Polymerizing, and Controlled Drug Delivery", Nanoscale Research Letters, 2014, 9(447), 11 pages.
Yu et al., "CART Cell Therapy for Prostate Cancer: Status and Promise," OncoTargets and Therapy, 2019, 12:391-395.

(56) References Cited

OTHER PUBLICATIONS

Canadian Office Action mailed Oct. 25, 2023 for Canadian Application No. 3,088,161, a foreign counterpart to U.S. Pat. No. 10,561,686, 4 pages.
Japanese Office Action mailed Jan. 16, 2024 for Japanese Application No. 2020-558861, a foreign counterpart to U.S. Pat. No. 10,561,686, 7 pages.
Office Action for Australian Application No. 2019327490, Dated May 20, 2025, 5 pages.
Finney, et al., "CD19 CAR T Cell Product and Disease Attributes Predict Leukemia Remission Durability," The Journal of Clinical Investigation, vol. 129, No. 5, May 2019, pp. 2123-2132.
Gaut, et al., "Granulocyte Colony-Stimulating Factor (G-CSF) Interactions with Chimeric Antigen Receptor (CAR) T-Cell Therapy for Diffuse Large B-Cell Lymphoma," Blood, vol. 134, Supplemental_1, Nov. 2019, 4 pages.
Gene-NCBI, Search Results for "(pap) and 'Homo sapiens'[porgn:_txid9606]", downloaded Jan. 15, 2025 from https://www.ncbi.nlm.nih.gov/gene, 8 pages.
Office Action for Korean Application No. 10-2021-7025235, Dated Aug. 19, 2025, 26 pages.
Neumann, et al., "The Safety Profile of Filgrastim and Pegfilgrastim," Eds. G. Molineux et al., In: Twenty Years of G-CSF, Clinical and Nonclinical Discoveries, Basel: Springer Basel, 2011, pp. 395-408.
Prazma, et al., "Dendritic Cell CD83: A Therapeutic Target or Innocent Bystander?" Immunology Letters, vol. 115, 2008, pp. 1-8.
Office Action for Singapore Application No. 11202107269X, Dated Apr. 29, 2025, 9 pages.
Spunt, et al., "Phase II, Randomized, Open-Label Study of Pegfilgrastim-Supported VDC/IE Chemotherapy in Pediatric Sarcoma Patients," Journal of Clinical Oncology, vol. 28, No. 8, Mar. 2010, pp. 1329-1336.
Stevenson, et al., "Molecular Markers of B-Cell Lymphoma," Cancer Biology, vol. 9, 1999, pp. 139-147.
Winkler, et al. "B-Lymphopoiesis is Stopped by Mobilizing Doses of G-CSF and is Rescued by Overexpression of the Anti-Apoptotic Protein Bcl2," Hematologica, vol. 98, No. 3, 2013, pp. 325-333.
Zhukovsky, et al., "Bispecific Antibodies and CARs: Generalized Immunotherapeutics Harnessing T Cell Redirection," Current Opinion in Immunology, vol. 40, Mar. 2016, pp. 24-35.
Office Action for Canadian Application No. 3,110,096, Dated Jan. 27, 2025, 5 pages.
Office Action for Canadian Application No. 3, 125,646, dated Dec. 19, 2025, 7 pages.
Examination Report for Australian Application No. 2019327490, Dated Feb. 16, 2026, 2 pages.
Hudecek, et al., "Receptor Affinity and Extracellular Domain Modifications Affect Tumor Recognition by ROR1-Specific Chimeric Antigen Receptor T-Cells," Clinical Cancer Research, vol. 19, No. 12, Jun. 2013, pp. 3153-3164.
Jensen, et al., "Designing Chimeric Antigen Receptors to Effectively and Safely Target Tumors," Current Opinion in Immunology, vol. 33, Apr. 2015, pp. 9-15.
Mihara, et al., "Synergistic and Persistent Effect of T-Cell Immonotherapy with Anti-CD19 or Anti-CD38 Chimeric Receptor in Conjunction with Rituximab on B-Cell Non-Hodgkin Lymphoma," British Journal of Haematology, vol. 151, Jul. 2010, pp. 37-46.
NCT02465983 Clinical Trial "Pilot Study of Autologous T-Cells in Patients with Metastatic Pancreatic Cancer" May 28, 2015, from https://clinicaltrials.gov/study/NCT02465983, 1 page.

* cited by examiner

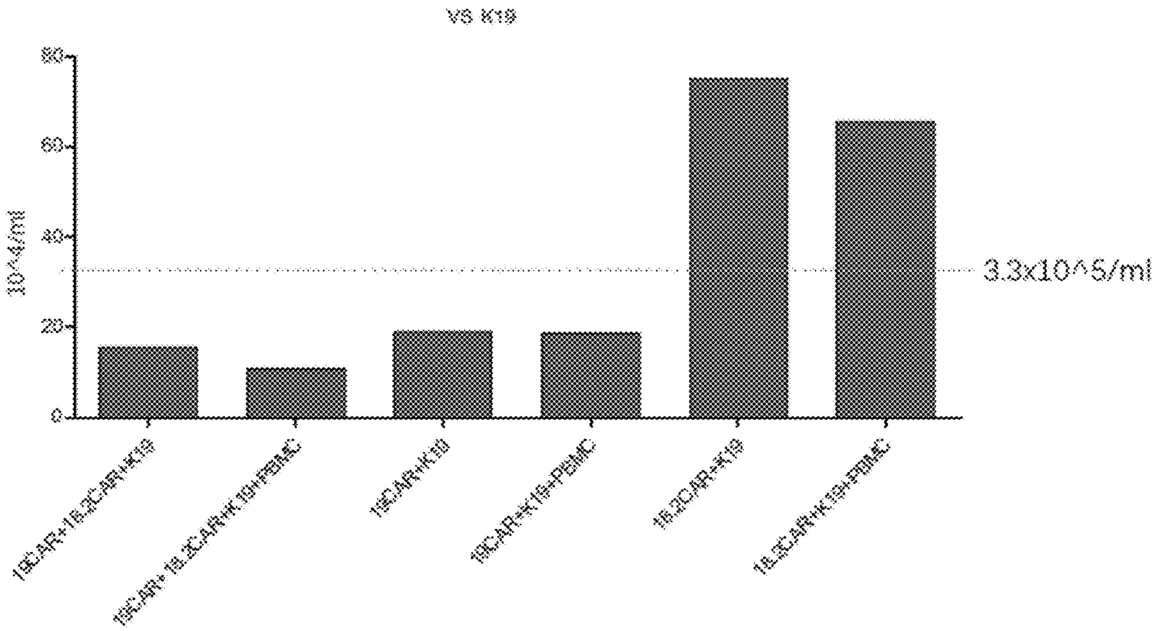
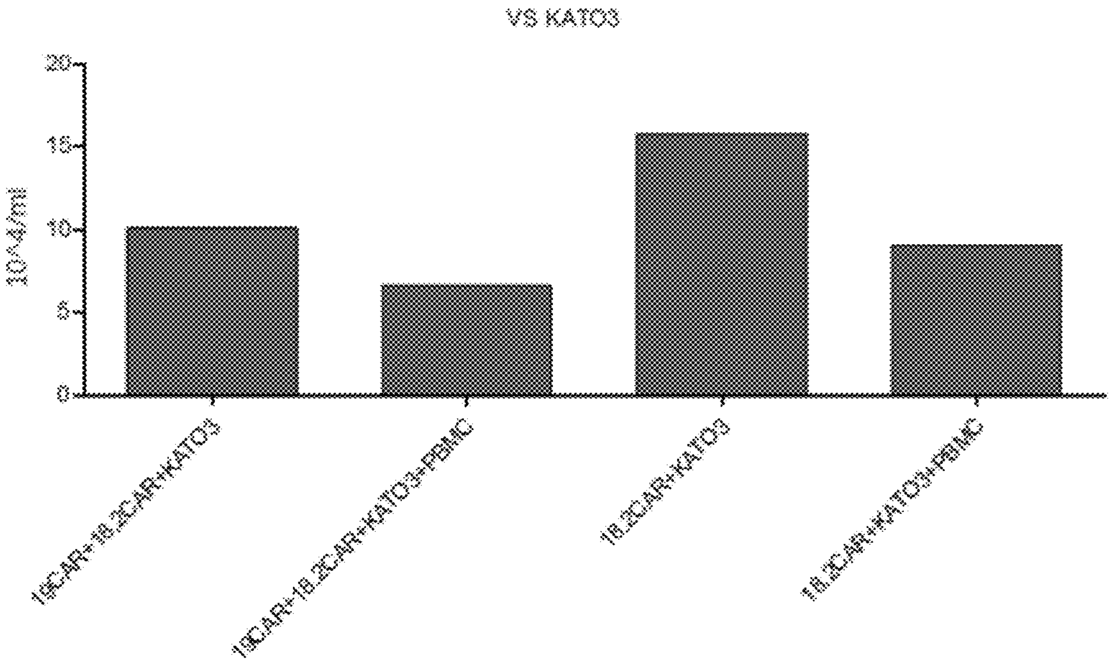
FIG. 20

312
308
304
316
24h AFP TCRT CD137+ MFI
CD137 MFI
25000
20000
15000
10000
5000
0
COUPLE CAR
COUPLECAR+K19
COUPLECAR+PBMC
COUPLECAR+K19+PBMC 310
306
302
314
24h AFP TCRT CD137+ percentage
CD137+ (%)
50
45
40
35
30
25
10
8
6
4
2
0
COUPLE CAR
COUPLECAR+K19
COUPLECAR+PBMC
COUPLECAR+K19+PBMC

GZMB pg/ml 25000
20000
15000
10000
5000
0

6701
6701+PBMC
6404
6404+6701
6404+8226-BCMA
6404+PBMC
6404+6701+PBMC

IL6 pg/ml 400
300
200
100
0

6701
6701+PBMC
6404
6404+6701
6404+8226-BCMA
6404+PBMC
6404+6701+PBMC

Composition and Method of enhancing modified cells' expansion

Examples:
Controller and Regulatory elements may be incorporated into such as NFAT, FOXP3, NFkB, AP-1, or NOTCH as well as suicide genes (RQR8 )
Linker: 2A and IRES
TA: Therapeutic agent such as IL-6, IL12, and IFNy The absolute number of T cell (x10^4)

300
250
200
150
100
50
0

0 1 2 3 4 5 6 7

Day

CD19-CAR(CD19CAR+NT)
CD19-CAR(CD19CAR+NT+B cell)
CD19-CAR(CD19CAR+NT+K19)
NT(CD19CAR+NT)
NT(CD19CAR+NT+B cell)
NT(CD19CAR+NT+K19)

FIG. 63A
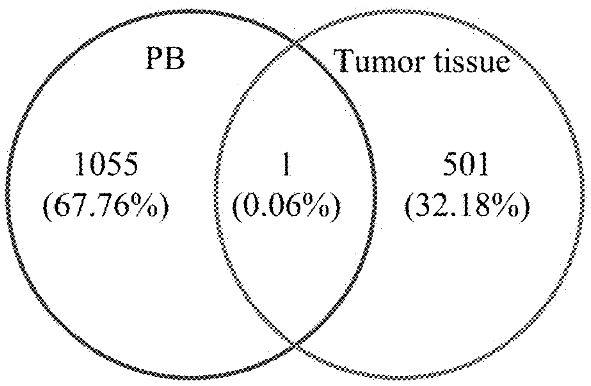
FIG. 63B
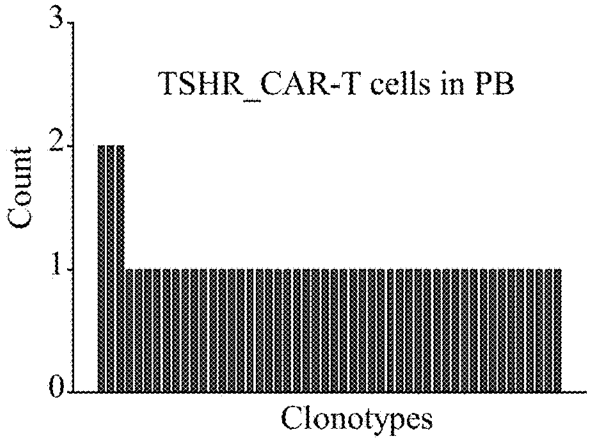
FIG. 63C
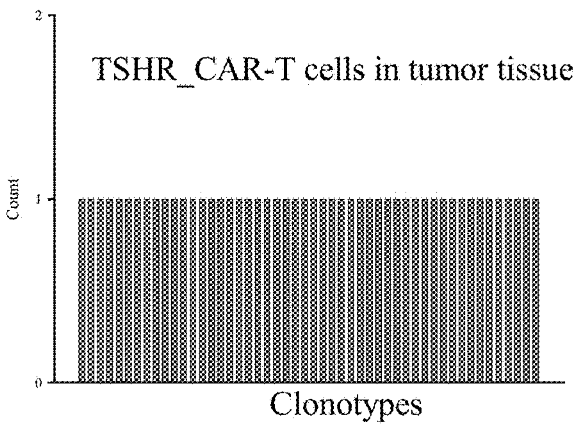
| Clonotype | PB | Tumor tissue | TRA_cdr3 | TRB_cdr3 |
|---|---|---|---|---|
| 1 | TSHR_CAR | TSHR_CAR | CAVRSGGYQKVTF | CASSSGQGVTYEQYF |
FIG. 63D

FIG. 65B

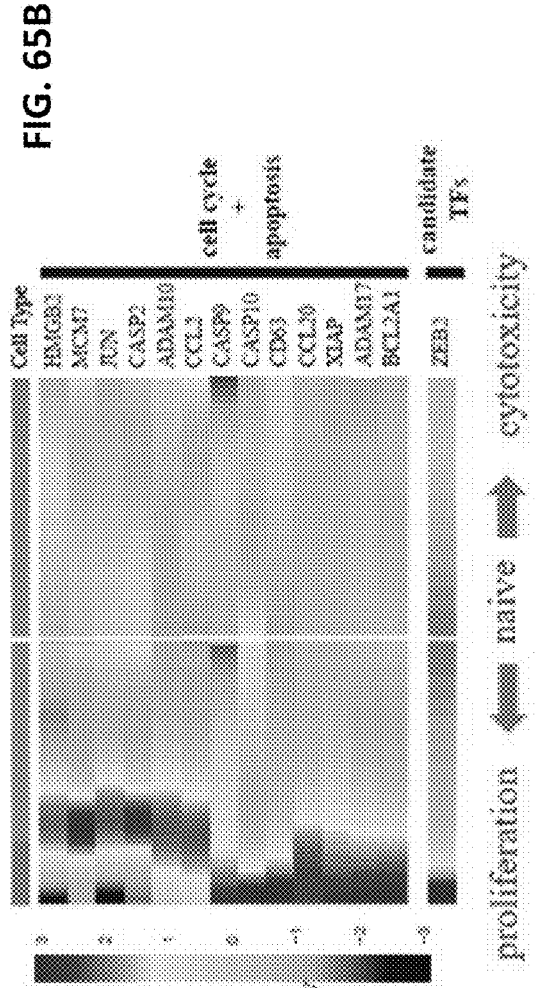

FIG. 65D

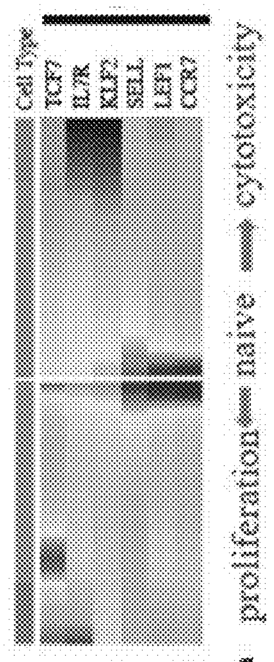

FIG. 65A

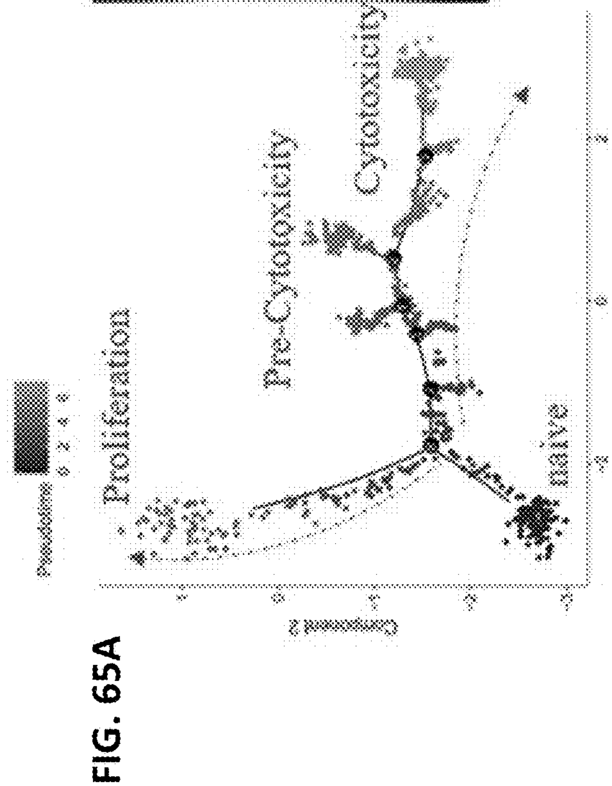

FIG. 65C

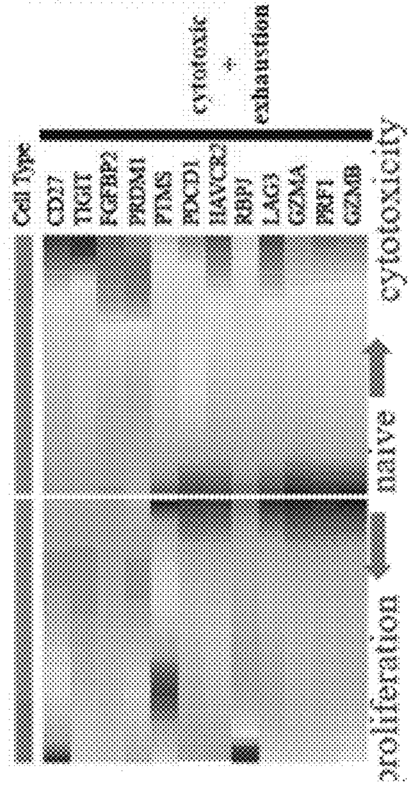

Pseudotime
Proliferation
Pre-Cytotoxicity
Cytotoxicity
naive
Component 1
Component 2
Cell Type
HMGB2
MCM7
JUN
CASP2
ADAM10
CCL3
CASP9
CASP10
CD63
CCL20
XIAP
ADAM17
BCL2A1
ZEB2
cell cycle
+
apoptosis
candidate
TFs
proliferation
naive
cytotoxicity
Cell Type
CD27
TIGIT
FGFBP2
PRDM1
PTMS
PDCD1
HAVCR2
RBPJ
LAG3
GZMA
PRF1
GZMB
cytotoxic
+
exhaustion
proliferation
naive
cytotoxicity
Cell Type
TCF7
IL7R
KLF2
SELL
LEF1
CCR7
proliferation
naive
cytotoxicity The Patient achieved CR Immunotherapeutic system 102

Function Component 104

CAR T, TIL & TCR and other cellular Therapy

Oncolytic virus therapy

Chemotherapy

Tumor vaccine therapy

Metabolism target therapy

●●●

Targeted Therapy

Coupling Component 106

CAR T/NK Cell

CAR T targeting WBC antigen

CAR T targeting virus (e.g., EBV)

CAR T targeting nonessential tissue or antigen (e.g., albumin)

Blood (e.g., PBMC) Stimulation leukocytes stimulation

DC stimulation

T cell Stimulation

Other Cells' or components' stimulation

●●●

Antigen/Vaccine Stimulation

Controlling Component 108

Suicide system

Conditional Gene expression system

●●●

Gene Modulation system

Coupling Subject's initial immune response with desired Immunotherapy

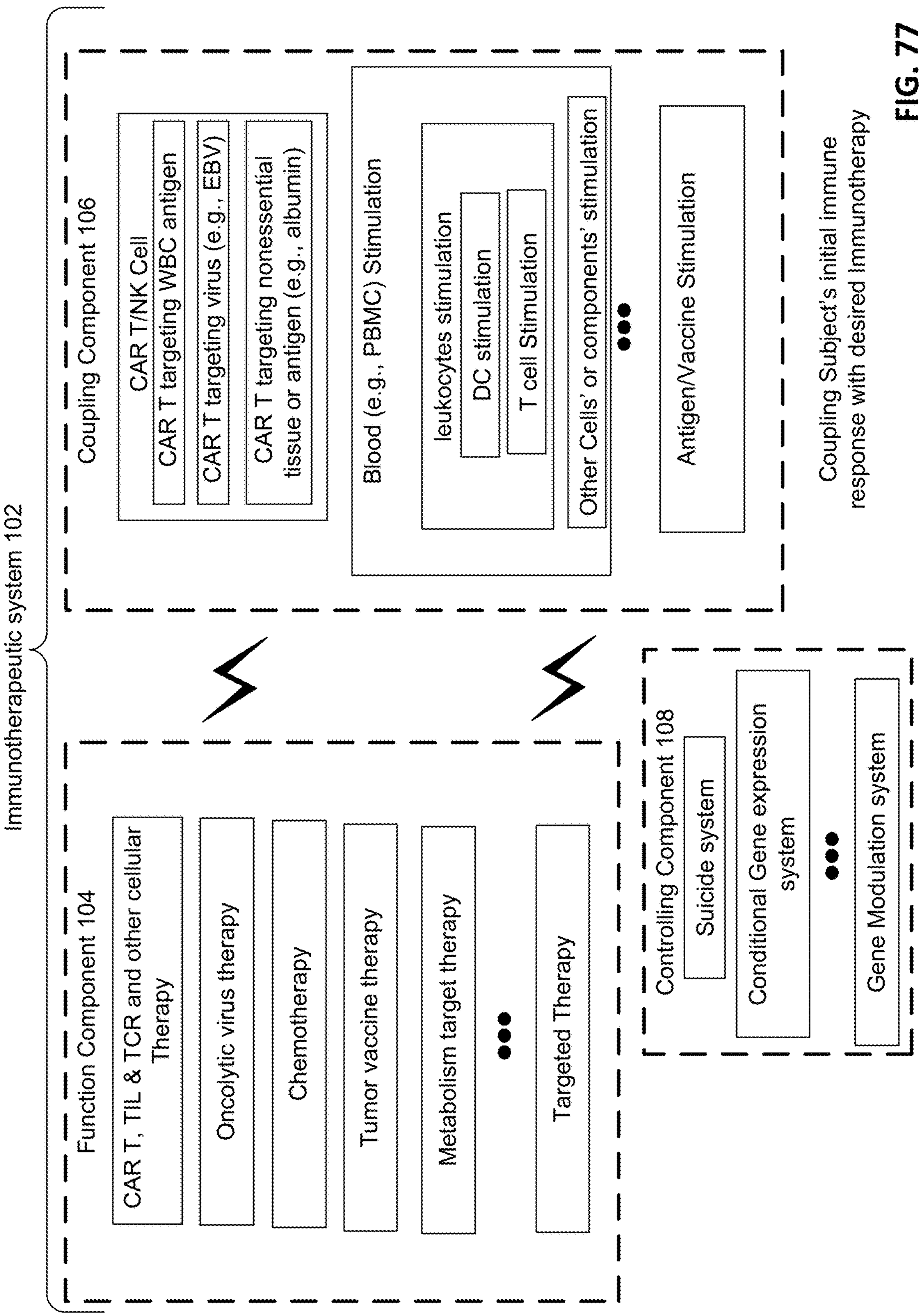

FIG. 77

Schematic overview of the process for combination of CAR T cells and tumor-infiltrating lymphocytes Dendritic Cell Activation antigen cancer vaccine nanoparticles agonist antibody anti-TIM3 RMT3-23 anti-CD40 ChiLob 4/7

TLR ligand

TLR2 Pam3Cys

TLR3 poly-(I:C)

TLR4 LPS

TLR7 R-848

TLR9 unmethylated CpG DNA agonist

Dectin-1 agonist

CD40 ligand others

HSP70

IFN β

GM-SCF

Flt3-Ligand

TNFα

Combination may achieve better effects

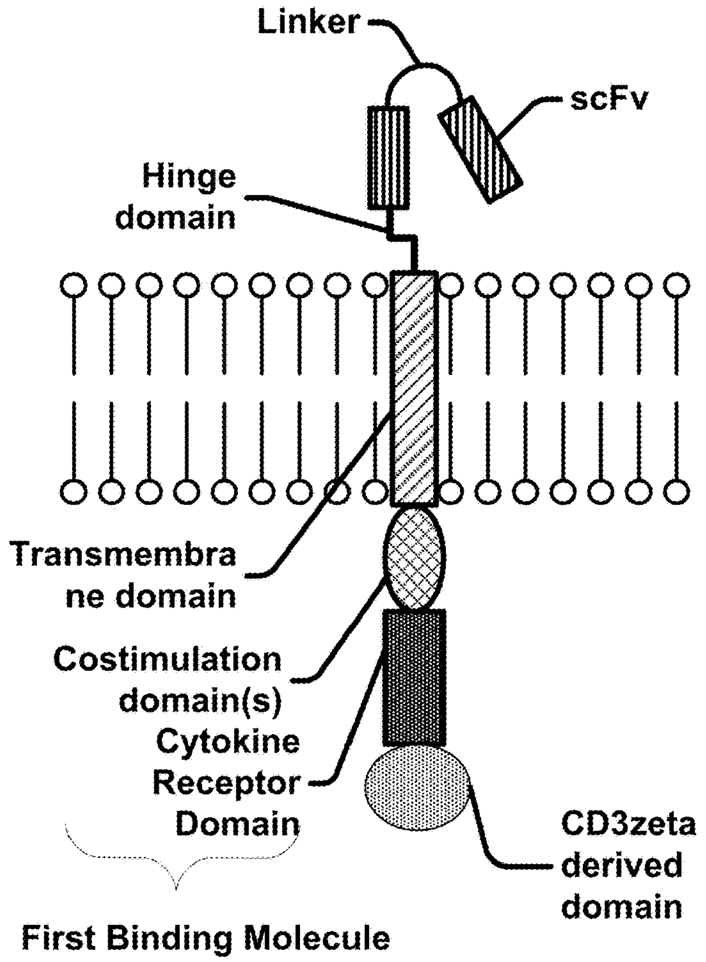
Transmembrane Domain and Co-stimulation Domain: for example,
41BB、CD28、CD27、CD63、CD44、TGFBR3、TNFRSF1A、TNFRSF13、TNFRSF14
E.g., one of SEQ IDS: 509-512
Cytokine receptor domain: for example,
IL2RB（stat5）、IL2RB（truncated）、IL12RB1（stat5）、IL12RB2（stat4）
E.g., one of SEQ ID NOS: 513-520
CD3zeta derived domain: for example,
CD3z(mut P→F)-YRHQ、YRHQ（alone）
E.g., one of SEQ ID NOS: 521-526
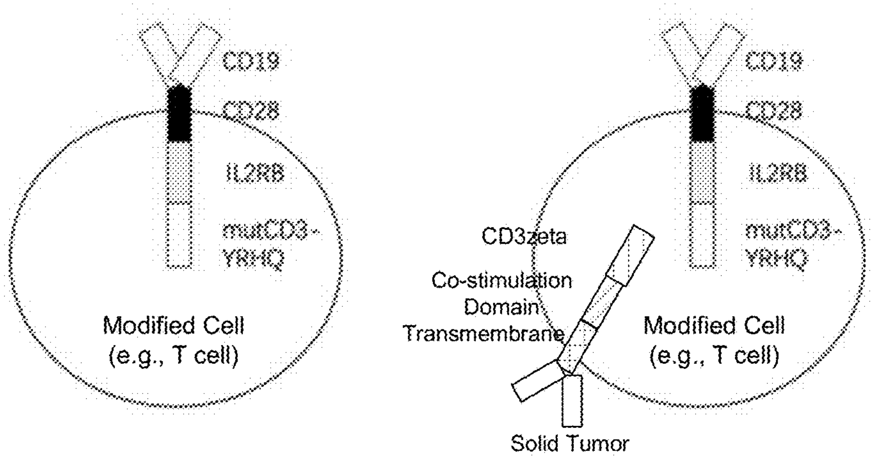
Embodiment 8702 Embodiment 8704
FIG. 87

FIG. 100
B cell Clustering 24 hours in a CoupledCAR System
0h
24h
Two groups of unique B cells were found, namely C5 and C7 clusters
2
3
4
5
6
7
8
9

| Gene | Pvalue | Mean(C1 | std(C1 | Mean(others) | std(others) | lgF2C | pathway |
|---|---|---|---|---|---|---|---|
| IL2 | 1.95E-15 | 0.16 | 0.462 | 0.044 | 0.239 | 1.856 | KEGG_CYTOKINE_CYTOKINE_RECEPTOR_INTERACTION |
| CCR4 | 6.59E-115 | 1.064 | 0.986 | 0.296 | 0.513 | 1.846 | KEGG_CYTOKINE_CYTOKINE_RECEPTOR_INTERACTION |
| CCR4 | 6.59E-115 | 1.064 | 0.986 | 0.296 | 0.513 | 1.846 | KEGG_CHEMOKINE_SIGNALING_PATHWAY |
| IL18R1 | 3.14E-60 | 0.605 | 0.789 | 0.184 | 0.406 | 1.72 | KEGG_CYTOKINE_CYTOKINE_RECEPTOR_INTERACTION |
| IL3 | 2.29E-74 | 0.973 | 1.058 | 0.321 | 0.677 | 1.6 | KEGG_CYTOKINE_CYTOKINE_RECEPTOR_INTERACTION |
| CCR8 | 2.90E-49 | 0.573 | 0.783 | 0.199 | 0.408 | 1.526 | KEGG_CYTOKINE_CYTOKINE_RECEPTOR_INTERACTION |
| CCR8 | 2.90E-49 | 0.573 | 0.783 | 0.199 | 0.408 | 1.526 | KEGG_CHEMOKINE_SIGNALING_PATHWAY |
| IL1RAP | 2.53E-30 | 0.351 | 0.609 | 0.128 | 0.326 | 1.458 | KEGG_CYTOKINE_CYTOKINE_RECEPTOR_INTERACTION |
| CCR1 | 6.77E-11 | 0.152 | 0.451 | 0.059 | 0.243 | 1.368 | KEGG_CYTOKINE_CYTOKINE_RECEPTOR_INTERACTION |
| CCR1 | 6.77E-11 | 0.152 | 0.451 | 0.059 | 0.243 | 1.368 | KEGG_CHEMOKINE_SIGNALING_PATHWAY |
| CXCL9 | 8.50E-10 | 0.159 | 0.497 | 0.062 | 0.302 | 1.366 | KEGG_CYTOKINE_CYTOKINE_RECEPTOR_INTERACTION |
| CXCL9 | 8.50E-10 | 0.159 | 0.497 | 0.062 | 0.302 | 1.366 | KEGG_CHEMOKINE_SIGNALING_PATHWAY |
| CXCR6 | 2.95E-21 | 0.386 | 0.78 | 0.151 | 0.421 | 1.353 | KEGG_CYTOKINE_CYTOKINE_RECEPTOR_INTERACTION |
| CXCR6 | 2.95E-21 | 0.386 | 0.78 | 0.151 | 0.421 | 1.353 | KEGG_CHEMOKINE_SIGNALING_PATHWAY |
| CCL17 | 3.26E-14 | 0.214 | 0.533 | 0.084 | 0.319 | 1.343 | KEGG_CYTOKINE_CYTOKINE_RECEPTOR_INTERACTION |
| CCL17 | 3.26E-14 | 0.214 | 0.533 | 0.084 | 0.319 | 1.343 | KEGG_CHEMOKINE_SIGNALING_PATHWAY |
| CCL22 | 3.80E-31 | 0.49 | 0.774 | 0.198 | 0.478 | 1.31 | KEGG_CYTOKINE_CYTOKINE_RECEPTOR_INTERACTION |
| CCL22 | 3.80E-31 | 0.49 | 0.774 | 0.198 | 0.478 | 1.31 | KEGG_CHEMOKINE_SIGNALING_PATHWAY |
| CCL1 | 7.14E-87 | 1.309 | 1.125 | 0.533 | 0.846 | 1.296 | KEGG_CYTOKINE_CYTOKINE_RECEPTOR_INTERACTION |
| CCL1 | 7.14E-87 | 1.309 | 1.125 | 0.533 | 0.846 | 1.296 | KEGG_CHEMOKINE_SIGNALING_PATHWAY |
| CCR2 | 1.45E-14 | 0.251 | 0.588 | 0.107 | 0.331 | 1.227 | KEGG_CYTOKINE_CYTOKINE_RECEPTOR_INTERACTION |
| CCR2 | 1.45E-14 | 0.251 | 0.588 | 0.107 | 0.331 | 1.227 | KEGG_CHEMOKINE_SIGNALING_PATHWAY |
| TNFRSF9 | 1.24E-17 | 0.288 | 0.592 | 0.126 | 0.353 | 1.196 | KEGG_CYTOKINE_CYTOKINE_RECEPTOR_INTERACTION |
| IL6ST | 1.22E-41 | 0.625 | 0.784 | 0.276 | 0.49 | 1.178 | KEGG_CYTOKINE_CYTOKINE_RECEPTOR_INTERACTION |
| FASLG | 3.07E-10 | 0.156 | 0.435 | 0.069 | 0.244 | 1.172 | KEGG_CYTOKINE_CYTOKINE_RECEPTOR_INTERACTION |
| XCL2 | 2.81E-29 | 0.538 | 0.807 | 0.24 | 0.544 | 1.167 | KEGG_CYTOKINE_CYTOKINE_RECEPTOR_INTERACTION |
| XCL2 | 2.81E-29 | 0.538 | 0.807 | 0.24 | 0.544 | 1.167 | KEGG_CHEMOKINE_SIGNALING_PATHWAY |
| BMPR1A | 5.78E-07 | 0.103 | 0.356 | 0.047 | 0.195 | 1.126 | KEGG_CYTOKINE_CYTOKINE_RECEPTOR_INTERACTION |
| CD40 | 4.54E-06 | 0.102 | 0.369 | 0.047 | 0.235 | 1.107 | KEGG_CYTOKINE_CYTOKINE_RECEPTOR_INTERACTION |
| CSF2 | 6.33E-92 | 1.694 | 1.224 | 0.806 | 1.018 | 1.071 | KEGG_CYTOKINE_CYTOKINE_RECEPTOR_INTERACTION |
| CSF1 | 2.66E-20 | 0.435 | 0.741 | 0.213 | 0.473 | 1.03 | KEGG_CYTOKINE_CYTOKINE_RECEPTOR_INTERACTION |
| TGFBR2 | 1.19E-41 | 0.722 | 0.8 | 0.365 | 0.515 | 0.985 | KEGG_CYTOKINE_CYTOKINE_RECEPTOR_INTERACTION |
| IL13 | 3.48E-41 | 1.288 | 1.401 | 0.653 | 1.034 | 0.981 | KEGG_CYTOKINE_CYTOKINE_RECEPTOR_INTERACTION |
| XCL1 | 4.82E-58 | 1.378 | 1.21 | 0.703 | 0.98 | 0.971 | KEGG_CYTOKINE_CYTOKINE_RECEPTOR_INTERACTION |
| XCL1 | 4.82E-58 | 1.378 | 1.21 | 0.703 | 0.98 | 0.971 | KEGG_CHEMOKINE_SIGNALING_PATHWAY |
| IL17RB | 9.01E-06 | 0.158 | 0.544 | 0.082 | 0.326 | 0.958 | KEGG_CYTOKINE_CYTOKINE_RECEPTOR_INTERACTION |
| CCL3 | 1.31E-64 | 1.294 | 1.054 | 0.674 | 0.827 | 0.941 | KEGG_CYTOKINE_CYTOKINE_RECEPTOR_INTERACTION |
| CCL3 | 1.31E-64 | 1.294 | 1.054 | 0.674 | 0.827 | 0.941 | KEGG_CHEMOKINE_SIGNALING_PATHWAY |

FIG. 103

PRESENTING CELL AND USE THEREOF IN CELL THERAPY

CROSS REFERENCE TO RELATED APPLICATIONS

This application claims the benefit of U.S. Provisional Application 62/889,926, filed Aug. 21, 2019; U.S. Provisional Application 62/891,131, filed Aug. 23, 2019; U.S. Provisional Application 62/902,766, filed Sep. 19, 2019; U.S. Provisional Application 62/932,587, filed Nov. 8, 2019; U.S. Provisional Application 63/005,866, filed Apr. 6, 2020; U.S. Provisional Application 63/040,851, filed Jun. 18, 2020; U.S. Provisional Application 63/046,859, filed Jul. 1, 2020; U.S. Provisional Application 63/054,017, filed Jul. 20, 2020; and U.S. Application 16/996,237, filed Aug. 18, 2020, which are hereby all incorporated by reference in their entirety.

SEQUENCE LISTING INFORMATION

A computer readable textfile, entitled "SDS1.0097US_ST25.txt," created on or about Aug. 20, 2020 with a file size of about 1.17 MB, contains the sequence listing for this application and is hereby incorporated by reference in its entirety.

TECHNICAL FIELD

The present disclosure relates to compositions and methods for expanding and maintaining modified cells including genetically modified cells, for example, maintaining the number of modified cells, and uses thereof in the treatment of diseases, including cancer.

BACKGROUND

Cancer is known as malignant tumors involving abnormal cell growth with the potential to invade or spread to other parts of the body. In humans, there are more than one hundred types of cancer. One example is breast cancer occurring in the epithelial tissue of the breast. Since breast cancer cells lose the characteristics of normal cells, the connection between breast cancer cells is lost. Once cancer cells are exfoliated, they spread over the entire body via the blood and/or lymph systems and therefore become life-threatening. Currently, breast cancer has become one of the common threats to women's physical and mental health. Although immunotherapy (e.g., chimeric antigen receptor T (CAR T) cell therapy) has been proven to be effective for treating some cancers, there is still a need to improve immunotherapy so that it is effective in treating more cancers including those involving solid tumors.

SUMMARY

The present disclosure describes a method of in vivo cell capabilities, the method comprising: administering an effective amount of cells comprising an antigen binding molecule to a subject; and administering an effective amount of presenting cells expressing a solid tumor antigen that the binding molecule binds.

The present disclosure also describes a method of activating and/or expanding cells, the method comprising: providing a population of lymphocytes comprising T cells or NK cells; providing a population of Antigen-presenting cells (APCs); stimulating the population of APCs cells; contacting the population of lymphocytes with the stimulated population of APCs; and allowing the population of lymphocytes to be activated and/or expanded. In embodiments, the APCs comprise dendritic cells, macrophages, Langerhans cells and B cells, T cells, or a combination thereof.

This Summary is not intended to identify key features or essential features of the claimed subject matter, nor is it intended to be used to limit the scope of the claimed subject matter.

BRIEF DESCRIPTION OF THE DRAWINGS

The Detailed Description is described with reference to the accompanying figures. The use of the same reference numbers in different figures indicates similar or identical items.

FIG. 20 shows results of killing assays of various cell cultures.

FIGS. 63A-63D show rare clonotype was found to be shared by TSHR CAR T cells in PB and tumor tissue. (TRAcdr3: SEQ ID NO: 364 and TRB_cdr3: SEQ ID NO: 365)

FIGS. 65A-65D show another inferred developmental trajectory of CAR+ CD8 T cell in tumor tissue suggesting a branched structure with differentiated proliferation and cytotoxicity T cells.

FIG. 77 shows a schematic overview of an immunotherapeutic system (CoupledCAR®).

FIG. 87 shows a schematic overview of another exemplary implementation of the immunotherapeutic system in FIG. 77.

FIG. 103 shows highly expressed genes in PAP CART cells in TC1.

DETAILED DESCRIPTION

Figure 1:
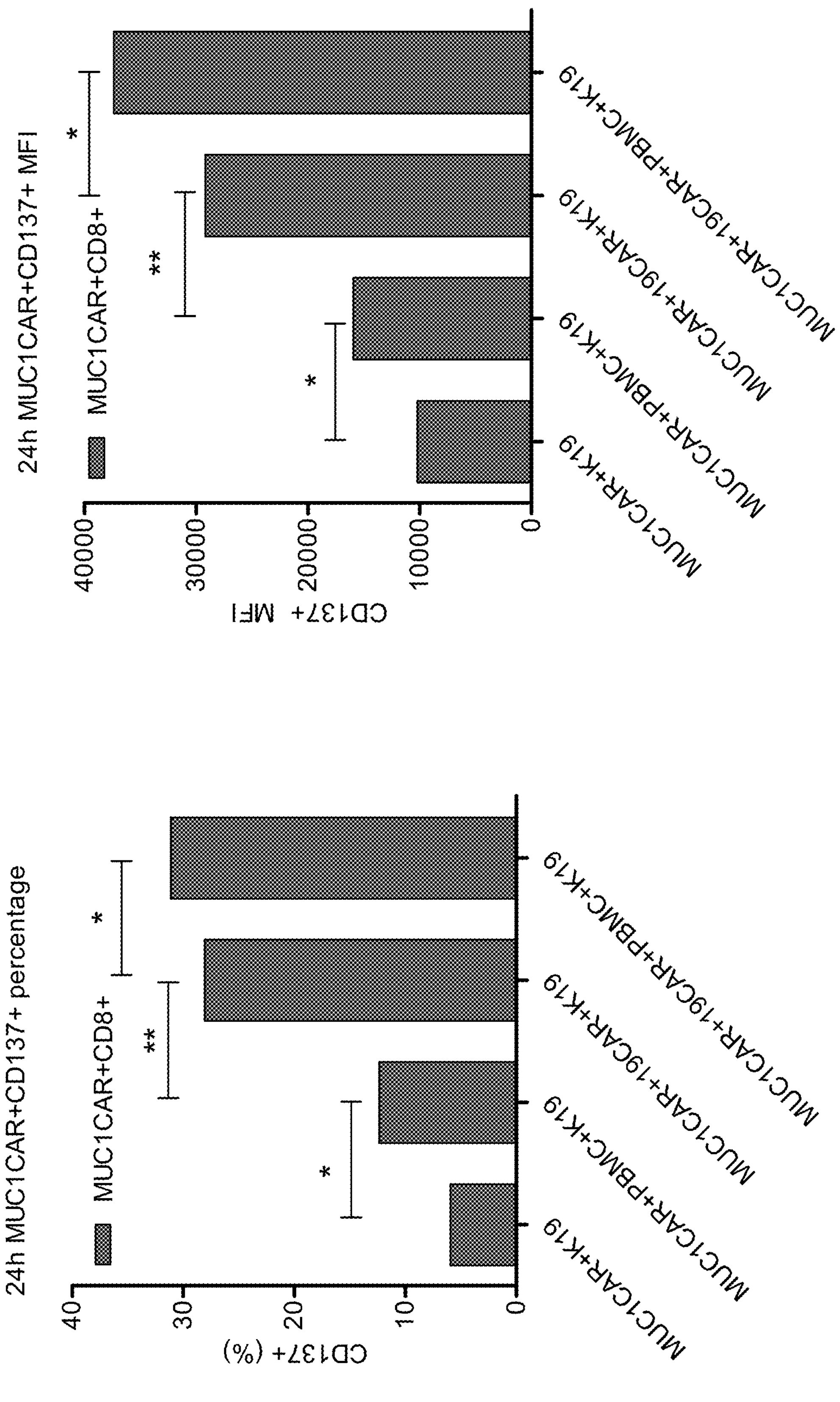
FIG. 1 shows results of flow cytometry analysis of CD19 CART cells co-cultured with tMUC1 CART cells in the presence of K19 cells.

Unless defined otherwise, all technical and scientific terms used herein have the same meaning as commonly understood by those of ordinary skill in the art to which the disclosure belongs. Although any method and material similar or equivalent to those described herein can be used in the practice or testing of the present disclosure, preferred methods and materials are described. For the purposes of the present disclosure, the following terms are defined below.

The articles "a" and "an" are used herein to refer to one or to more than one (i.e., to at least one) of the grammatical object of the article. By way of example, "an element" means one element or more than one element.

By "about" is meant a quantity, level, value, number, frequency, percentage, dimension, size, amount, weight or length that varies by as much as 20, 15, 10, 9, 8, 7, 6, 5, 4, 3, 2 or 1% to a reference quantity, level, value, number, frequency, percentage, dimension, size, amount, weight or length.

The term "activation," as used herein, refers to the state of a cell that has been sufficiently stimulated to induce detectable cellular proliferation. Activation can also be associated with induced cytokine production and detectable effector functions. The term "activated T cells" refers to, among other things, T cells that are undergoing cell division.

The term "antibody" is used in the broadest sense and refers to monoclonal antibodies (including full length monoclonal antibodies), polyclonal antibodies, multi-specific antibodies (e.g., bispecific antibodies), and antibody fragments so long as they exhibit the desired biological activity or function. The antibodies in the present disclosure may exist in a variety of forms including, for example, polyclonal antibodies; monoclonal antibodies; Fv, Fab, Fab', and $F(ab')_2$ fragments; as well as single chain antibodies and humanized antibodies (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426).

The term "antibody fragments" refers to a portion of a full-length antibody, for example, the antigen binding or variable region of the antibody. Other examples of antibody fragments include Fab, Fab', $F(ab')_2$, and Fv fragments; diabodies; linear antibodies; single-chain antibody molecules; and multi-specific antibodies formed from antibody fragments.

The term "Fv" refers to the minimum antibody fragment which contains a complete antigen-recognition and -binding site. This fragment consists of a dimer of one heavy- and one light-chain variable region domain in tight, non-covalent association. From the folding of these two domains emanates six hypervariable loops (3 loops each from the H and L chain) that contribute amino acid residues for antigen binding and confer antigen binding specificity to the antibody. However, even a single variable domain (or half of an Fv including only three complementarity determining regions (CDRs) specific for an antigen) has the ability to recognize and bind antigen, although at a lower affinity than the entire binding site (the dimer).

An "antibody heavy chain," as used herein, refers to the larger of the two types of polypeptide chains present in all antibody molecules in their naturally occurring conformations. An "antibody light chain," as used herein, refers to the smaller of the two types of polypeptide chains present in all antibody molecules in their naturally occurring conformations. K and A light chains refer to the two major antibody light chain isotypes.

The term "synthetic antibody" refers to an antibody which is generated using recombinant DNA technology, such as, for example, an antibody expressed by a bacteriophage. The term also includes an antibody which has been generated by the synthesis of a DNA molecule encoding the antibody and the expression of the DNA molecule to obtain the antibody or to obtain an amino acid encoding the antibody. The synthetic DNA is obtained using technology that is available and well known in the art.

The term "antigen" refers to a molecule that provokes an immune response, which may involve either antibody production, or the activation of specific immunologically-competent cells, or both. Antigens include any macromolecule, including all proteins or peptides, or molecules derived from recombinant or genomic DNA. For example, DNA including a nucleotide sequence or a partial nucleotide sequence encoding a protein or peptide that elicits an immune response, and therefore, encodes an "antigen" as the term is used herein. An antigen need not be encoded solely by a full-length nucleotide sequence of a gene. An antigen can be generated, synthesized or derived from a biological sample including a tissue sample, a tumor sample, a cell, or a biological fluid.

The term "anti-tumor effect" as used herein, refers to a biological effect associated with a decrease in tumor volume, a decrease in the number of tumor cells, a decrease in the number of metastases, decrease in tumor cell proliferation, decrease in tumor cell survival, an increase in life expectancy of a subject having tumor cells, or amelioration of various physiological symptoms associated with the cancerous condition. An "anti-tumor effect" can also be manifested by the ability of the peptides, polynucleotides, cells, and antibodies in the prevention of the occurrence of tumor in the first place.

The term "auto-antigen" refers to an endogenous antigen mistakenly recognized by the immune system as being foreign. Auto-antigens include cellular proteins, phosphoproteins, cellular surface proteins, cellular lipids, nucleic acids, glycoproteins, including cell surface receptors.

The term "autologous" is used to describe a material derived from a subject which is subsequently re-introduced into the same subject.

The term "allogeneic" is used to describe a graft derived from a different subject of the same species. As an example, a donor subject may be a related or unrelated to the recipient subject, but the donor subject has immune system markers which are similar to the recipient subject.

The term "xenogeneic" is used to describe a graft derived from a subject of a different species. As an example, the donor subject is from a different species than a recipient subject, and the donor subject and the recipient subject can be genetically and immunologically incompatible.

The term "cancer" is used to refer to a disease characterized by the rapid and uncontrolled growth of aberrant cells. Cancer cells can spread locally or through the bloodstream and lymphatic system to other parts of the body. Examples of various cancers include breast cancer, prostate cancer, ovarian cancer, cervical cancer, skin cancer, pancreatic cancer, colorectal cancer, renal cancer, liver cancer, brain cancer, lymphoma, leukemia, lung cancer, and the like.

Throughout this specification, unless the context requires otherwise, the words "comprise," "includes" and "including" will be understood to imply the inclusion of a stated step or element or group of steps or elements but not the exclusion of any other step or element or group of steps or elements.

The phrase "consisting of" is meant to include, and is limited to, whatever follows the phrase "consisting of." Thus, the phrase "consisting of" indicates that the listed elements are required or mandatory and that no other elements may be present.

The phrase "consisting essentially of" is meant to include any element listed after the phrase and can include other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they affect the activity or action of the listed elements. For example, if the element does not affect the expansion, function, or the phenotype of the cells, then the element is not required and is considered optional.

The terms "complementary" and "complementarity" refer to polynucleotides (i.e., a sequence of nucleotides) related by the base-pairing rules. For example, the sequence "A-G-T," is complementary to the sequence "T-C-A." Complementarity may be "partial," in which only some of the nucleic acids' bases are matched according to the base pairing rules, or there may be "complete" or "total" complementarity between the nucleic acids. The degree of complementarity between nucleic acid strands has significant effects on the efficiency and strength of hybridization between nucleic acid strands.

The term "corresponds to" or "corresponding to" refers to (a) a polynucleotide having a nucleotide sequence that is substantially identical or complementary to all or a portion of a reference polynucleotide sequence or encoding an amino acid sequence identical to an amino acid sequence in a peptide or protein; or (b) a peptide or polypeptide having an amino acid sequence that is substantially identical to a sequence of amino acids in a reference peptide or protein.

The term "co-stimulatory ligand," refers to a molecule on an antigen presenting cell (e.g., an APC, dendritic cell, B cell, and the like) that specifically binds a cognate co-stimulatory molecule on a T cell, thereby providing a signal which, in addition to the primary signal provided by, for instance, binding of a TCR/CD3 complex with an MHC molecule loaded with peptide, mediates a T cell response, including at least one of proliferation, activation, differentiation, and other cellular responses. A co-stimulatory ligand can include B7-1 (CD80), B7-2 (CD86), PD-L1, PD-L2, 4-1BBL, OX40L, inducible co-stimulatory ligand (ICOS-L), intercellular adhesion molecule (ICAM), CD30L, CD40, CD70, CD83, HLA-G, MICA, MICB, HVEM, lymphotoxin beta receptor, 3/TR6, ILT3, ILT4, HVEM, a ligand for CD7, an agonist or antibody that binds the Toll ligand receptor, and a ligand that specifically binds with B7-H3. A co-stimulatory ligand also includes, inter alia, an agonist or an antibody that specifically binds with a co-stimulatory molecule present on a T cell, such as CD27, CD28, 4-1BB, OX40, CD30, CD40, PD-1, ICOS, lymphocyte function-associated antigen-1 (LFA-1), CD2, CD7, LIGHT, NKG2C, B7-H3, and a ligand that specifically binds CD83.

The term "co-stimulatory molecule" refers to the cognate binding partner on a T cell that specifically binds with a co-stimulatory ligand, thereby mediating a co-stimulatory response by the T cell, such as proliferation. Co-stimulatory molecules include an MHC class I molecule, BTLA, and a Toll-like receptor.

The term "co-stimulatory signal" refers to a signal, which in combination with a primary signal, such as TCR/CD3 ligation, leads to T cell proliferation and/or upregulation or downregulation of key molecules.

The terms "disease" and "condition" may be used interchangeably or may be different in that the particular malady or condition may not have a known causative agent (so that etiology has not yet been worked out), and it is therefore not yet recognized as a disease but only as an undesirable condition or syndrome, wherein a more or less specific set of symptoms have been identified by clinicians. The term "disease" is a state of health of a subject wherein the subject cannot maintain homeostasis, and wherein if the disease is not ameliorated then the subject's health continues to deteriorate. In contrast, a "disorder" in a subject is a state of health in which the animal is able to maintain homeostasis, but in which the animal's state of health is less favorable than it would be in the absence of the disorder. Left untreated, a disorder does not necessarily cause a further decrease in the animal's state of health.

The term "effective" refers to adequate to accomplish a desired, expected, or intended result. For example, an "effective amount" in the context of treatment may be an amount of a compound sufficient to produce a therapeutic or prophylactic benefit.

The term "encoding" refers to the inherent property of specific sequences of nucleotides in a polynucleotide, such as a gene, a cDNA, or an mRNA, to serve as a template for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence (except that a "T" is replaced by a "U") and is usually provided in sequence listings, and the non-coding strand, used as the template for transcription of a gene or cDNA, can be referred to as encoding the protein or other product of that gene or cDNA.

The term "exogenous" refers to a molecule that does not naturally occur in a wild-type cell or organism but is typically introduced into the cell by molecular biological techniques. Examples of exogenous polynucleotides include vectors, plasmids, and/or man-made nucleic acid constructs encoding the desired protein. With regard to polynucleotides and proteins, the term "endogenous" or "native" refers to naturally-occurring polynucleotide or amino acid sequences that may be found in a given wild-type cell or organism. Also, a particular polynucleotide sequence that is isolated from a first organism and transferred to a second organism by molecular biological techniques is typically considered an "exogenous" polynucleotide or amino acid sequence with respect to the second organism. In specific embodiments, polynucleotide sequences can be "introduced" by molecular biological techniques into a microorganism that already contains such a polynucleotide sequence, for instance, to create one or more additional copies of an otherwise naturally-occurring polynucleotide sequence, and thereby facilitate overexpression of the encoded polypeptide.

The term "expression or overexpression" refers to the transcription and/or translation of a particular nucleotide sequence into a precursor or mature protein, for example, driven by its promoter. "Overexpression" refers to the production of a gene product in transgenic organisms or cells that exceeds levels of production in normal or non-transformed organisms or cells. As defined herein, the term "expression" refers to expression or overexpression.

The term "expression vector" refers to a vector including a recombinant polynucleotide including expression control (regulatory) sequences operably linked to a nucleotide sequence to be expressed. An expression vector includes sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., lentiviruses, retroviruses, adenoviruses, and adeno-associated viruses) that incorporate the recombinant polynucleotide.

Viruses can be used to deliver nucleic acids into a cell in vitro and in vivo (in a subject). Examples of viruses useful for delivery of nucleic acids into cells include retrovirus, adenovirus, herpes simplex virus, vaccinia virus, and adeno-associated virus.

There also exist non-viral methods for delivering nucleic acids into a cell, for example, electroporation, gene gun, sonoporation, magnetofection, and the use of oligonucleotides, lipoplexes, dendrimers, and inorganic nanoparticles.

The term "homologous" refers to sequence similarity or sequence identity between two polypeptides or between two polynucleotides when a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared ×100. For example, if 6 of 10 of the positions in two sequences are matched or homologous, then the two sequences are 60% homologous. By way of example, the DNA sequences ATTGCC and TATGGC share 50% homology. A comparison is made when two sequences are aligned to give maximum homology.

The term "immunoglobulin" or "Ig," refers to a class of proteins, which function as antibodies. The five members included in this class of proteins are IgA, IgG, IgM, IgD, and IgE. IgA is the primary antibody that is present in body secretions, such as saliva, tears, breast milk, gastrointestinal secretions and mucus secretions of the respiratory and genitourinary tracts. IgG is the most common circulating antibody. IgM is the main immunoglobulin produced in the primary immune response in most subjects. It is the most efficient immunoglobulin in agglutination, complement fixation, and other antibody responses, and is important in defense against bacteria and viruses. IgD is the immunoglobulin that has no known antibody function but may serve as an antigen receptor. IgE is the immunoglobulin that mediates immediate hypersensitivity by causing the release of mediators from mast cells and basophils upon exposure to the allergen.

The term "isolated" refers to a material that is substantially or essentially free from components that normally accompany it in its native state. The material can be a cell or a macromolecule such as a protein or nucleic acid. For example, an "isolated polynucleotide," as used herein, refers to a polynucleotide, which has been purified from the sequences which flank it in a naturally-occurring state, e.g., a DNA fragment which has been removed from the sequences that are normally adjacent to the fragment. Alternatively, an "isolated peptide" or an "isolated polypeptide" and the like, as used herein, refer to in vitro isolation and/or purification of a peptide or polypeptide molecule from its natural cellular environment, and from association with other components of the cell.

The term "substantially purified" refers to a material that is substantially free from components that are normally associated with it in its native state. For example, a substantially purified cell refers to a cell that has been separated from other cell types with which it is normally associated in its naturally occurring or native state. In some instances, a population of substantially purified cells refers to a homogenous population of cells. In other instances, this term refers simply to a cell that has been separated from the cells with which they are naturally associated in their natural state. In embodiments, the cells are cultured in vitro. In embodiments, the cells are not cultured in vitro.

In the context of the present disclosure, the following abbreviations for the commonly occurring nucleic acid bases are used. "A" refers to adenosine, "C" refers to cytosine, "G" refers to guanosine, "T" refers to thymidine, and "U" refers to uridine.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain an intron(s).

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. Moreover, the use of lentiviruses enables integration of the genetic information into the host chromosome resulting in stably transduced genetic information. HIV, SIV, and FIV are all examples of lentiviruses. Vectors derived from lentiviruses offer the means to achieve significant levels of gene transfer in vivo.

The term "modulating," refers to mediating a detectable increase or decrease in the level of a response in a subject compared with the level of a response in the subject in the absence of a treatment or compound, and/or compared with the level of a response in an otherwise identical but untreated subject. The term encompasses perturbing and/or affecting a native signal or response thereby mediating a beneficial therapeutic response in a subject, preferably, a human.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation.

The term "under transcriptional control" refers to a promoter being operably linked to and in the correct location and orientation in relation to a polynucleotide to control (regulate) the initiation of transcription by RNA polymerase and expression of the polynucleotide.

The term "overexpressed" tumor antigen or "overexpression" of the tumor antigen is intended to indicate an abnormal level of expression of the tumor antigen in a cell from a disease area such as a solid tumor within a specific tissue or organ of the patient relative to the level of expression in a normal cell from that tissue or organ. Patients having solid tumor or a hematological malignancy characterized by overexpression of the tumor antigen can be determined by standard assays known in the art.

Solid tumors are abnormal masses of tissue that usually do not contain cysts or liquid areas. Solid tumors can be benign or malignant. Different types of solid tumors are named for the type of cells that form them (such as sarcomas, carcinomas, and lymphomas). Examples of solid tumors, such as sarcomas and carcinomas, include fibrosarcoma, myxosarcoma, liposarcoma, chondrosarcoma, osteosarcoma, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme), astrocytoma, CNS lymphoma, germinoma, medulloblastoma, Schwannoma craniopharyogioma, ependymoma, pinealoma, hemangioblastoma, acoustic neuroma, oligodendroglioma, menangioma, neuroblastoma, retinoblastoma, and brain metastases).

A solid tumor antigen is an antigen expressed on a solid tumor. In embodiments, solid tumor antigens are also expressed at low levels on healthy tissue. Examples of solid tumor antigens and their related disease tumors are provided in Table 1.

TABLE 1

| Solid Tumor antigen | Disease tumor |
|---|---|
| PRLR | Breast Cancer |
| CLCA1 | colorectal Cancer |
| MUC12 | colorectal Cancer |
| GUCY2C | colorectal Cancer and other digestive cancer types |
| GPR35 | colorectal Cancer |
| CR1L | Gastric Cancer |
| MUC 17 | Gastric Cancer |
| TMPRSS11B | esophageal Cancer |
| MUC21 | esophageal Cancer |
| TMPRSS11E | esophageal Cancer |
| CD207 | bladder Cancer |
| SLC30A8 | pancreatic Cancer |
| CFC1 | pancreatic Cancer |
| SLC12A3 | Cervical Cancer |
| SSTR1 | Cervical tumor |
| GPR27 | Ovary tumor |
| FZD10 | Ovary tumor |
| TSHR | Thyroid Tumor |
| SIGLEC15 | Urothelial cancer |
| SLC6A3 | Renal cancer |
| KISS1R | Renal cancer |
| QRFPR | Renal cancer: |
| GPR119 | Pancreatic cancer |
| CLDN6 | Endometrial cancer/Urothelial cancer |
| UPK2 | Urothelial cancer (including bladder cancer) |
| ADAM12 | Breast cancer, pancreatic cancer and the like |
| SLC45A3 | Prostate cancer |
| ACPP | Prostate cancer |
| MUC21 | Esophageal cancer |
| MUC16 | Ovarian cancer |
| MS4A12 | Colorectal cancer |
| ALPP | Endometrial cancer |
| CEA | Colorectal carcinoma |
| EphA2 | Glioma |
| FAP | Mesotelioma |
| GPC3 | Lung squamous cell carcinoma |
| IL13-Rα2 | Glioma |
| Mesothelin | Metastatic cancer |
| PSMA | Prostate cancer |
| ROR1 | Breast lung carcinoma |
| VEGFR-II | Metastatic cancer |
| GD2 | Neuroblastoma |
| FR-α | Ovarian carcinoma |
| ErbB2 | Carcinomasb |
| EpCAM | Carcinomasa |
| EGFRvIII | Glioma-Glioblastoma |
| EGFR | Glioma-NSCL cancer |
| tMUC1 | Cholangiocarcinoma, Pancreatic cancer, Breast |
| PSCA | pancreas, stomach, or prostate cancer |
| FCER2, GPR18, FCRLA, CXCR5, FCRL3, FCRL2, HTR3A, and CLEC17A | breast cancer |
| TRPMI, SLC45A2, and SLC24A5 | Lymphoma |
| DPEP3 | Melanoma |
| KCNK16 | ovarian, testis |
| LIM2 or KCNV2 | Pancreatic |
| SLC26A4 | thyroid cancer |
| CD171 | Neuroblastoma |
| Glypican-3 | Sarcoma |
| IL-13 | Glioma |
| CD79a/b | Lymphoma |
| MAGE A4 | Lung cancer and multiple cancer types |

The term "parenteral administration" of a composition includes, e.g., subcutaneous (s.c.), intravenous (i.v.), intramuscular (i.m.), intrasternal injection, or infusion techniques.

The terms "patient," "subject," and "individual," and the like are used interchangeably herein and refer to any human, or animal, amenable to the methods described herein. In certain non-limiting embodiments, the patient, subject, or individual is a human or animal. In embodiments, the term "subject" is intended to include living organisms in which an immune response can be elicited (e.g., mammals). Examples of subjects include humans, and animals, such as dogs, cats, mice, rats, and transgenic species thereof.

A subject in need of treatment or in need thereof includes a subject having a disease, condition, or disorder that needs to be treated. A subject in need thereof also includes a subject that needs treatment for prevention of a disease, condition, or disorder.

The term "polynucleotide" or "nucleic acid" refers to mRNA, RNA, cRNA, rRNA, cDNA or DNA. The term typically refers to a polymeric form of nucleotides of at least 10 bases in length, either ribonucleotides or deoxynucleotides or a modified form of either type of nucleotide. The term includes all forms of nucleic acids including single and double-stranded forms of nucleic acids.

The terms "polynucleotide variant" and "variant" and the like refer to polynucleotides displaying substantial sequence identity with a reference polynucleotide sequence or polynucleotides that hybridize with a reference sequence under stringent conditions that are defined hereinafter. These terms also encompass polynucleotides that are distinguished from a reference polynucleotide by the addition, deletion or substitution of at least one nucleotide. Accordingly, the terms "polynucleotide variant" and "variant" include polynucleotides in which one or more nucleotides have been added or deleted or replaced with different nucleotides. In this regard, it is well understood in the art that certain alterations inclusive of mutations, additions, deletions, and substitutions can be made to a reference polynucleotide whereby the altered polynucleotide retains the biological function or activity of the reference polynucleotide or has increased activity in relation to the reference polynucleotide (i.e., optimized). Polynucleotide variants include, for example, polynucleotides having at least 50% (and at least 51% to at least 99% and all integer percentages in between, e.g., 90%, 95%, or 98%) sequence identity with a reference polynucleotide sequence described herein. The terms "polynucleotide variant" and "variant" also include naturally-occurring allelic variants and orthologs.

The terms "polypeptide," "polypeptide fragment," "peptide," and "protein" are used interchangeably herein to refer to a polymer of amino acid residues and to variants and synthetic analogues of the same. Thus, these terms apply to amino acid polymers in which one or more amino acid residues are synthetic non-naturally occurring amino acids, such as a chemical analogue of a corresponding naturally occurring amino acid, as well as to naturally-occurring amino acid polymers. In certain aspects, polypeptides may include enzymatic polypeptides, or "enzymes," which typically catalyze (i.e., increase the rate of) various chemical reactions.

The term "polypeptide variant" refers to polypeptides that are distinguished from a reference polypeptide sequence by the addition, deletion, or substitution of at least one amino acid residue. In embodiments, a polypeptide variant is distinguished from a reference polypeptide by one or more substitutions, which may be conservative or non-conservative. In embodiments, the polypeptide variant comprises conservative substitutions and, in this regard, it is well understood in the art that some amino acids may be changed to others with broadly similar properties without changing the nature of the activity of the polypeptide. Polypeptide variants also encompass polypeptides in which one or more amino acids have been added or deleted or replaced with different amino acid residues.

The term "promoter" refers to a DNA sequence recognized by the synthetic machinery of the cell or introduced synthetic machinery, required to initiate the specific transcription of a polynucleotide sequence. The term "expression control (regulatory) sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

The term "bind," "binds," or "interacts with" refers to a molecule recognizing and adhering to a second molecule in a sample or organism but does not substantially recognize or adhere to other structurally unrelated molecules in the sample. The term "specifically binds," as used herein with respect to an antibody, refers to an antibody which recognizes a specific antigen, but does not substantially recognize or bind other molecules in a sample. For example, an antibody that specifically binds an antigen from one species may also bind that antigen from one or more species. But, such cross-species reactivity does not itself alter the classification of an antibody as specific. In another example, an antibody that specifically binds an antigen may also bind different allelic forms of the antigen. However, such cross reactivity does not itself alter the classification of an antibody as specific. In some instances, the terms "specific binding" or "specifically binding," can be used in reference to the interaction of an antibody, a protein, or a peptide with a second chemical species, to mean that the interaction is dependent upon the presence of a particular structure (e.g., an antigenic determinant or epitope) on the chemical species; for example, an antibody recognizes and binds a specific protein structure rather than to any protein. If an antibody is specific for epitope "A," the presence of a molecule containing epitope A (or free, unlabeled A), in a reaction containing labeled "A" and the antibody, will reduce the amount of labeled A bound to the antibody.

By "statistically significant," it is meant that the result was unlikely to have occurred by chance. Statistical significance can be determined by any method known in the art. Commonly used measures of significance include the p-value, which is the frequency or probability with which the observed event would occur if the null hypothesis were true. If the obtained p-value is smaller than the significance level, then the null hypothesis is rejected. In simple cases, the significance level is defined at a p-value of 0.05 or less. A "decreased" or "reduced" or "lesser" amount is typically a "statistically significant" or a physiologically significant amount, and may include a decrease that is about 1.1, 1.2, 1.3, 1.4, 1.5, 1.6 1.7, 1.8, 1.9, 2, 2.5, 3, 3.5, 4, 4.5, 5, 6, 7, 8, 9, 10, 15, 20, 30, 40, or 50 or more times (e.g., 100, 500, 1000 times) (including all integers and decimal points in between and above 1, e.g., 1.5, 1.6, 1.7. 1.8, etc.) an amount or level described herein.

The term "stimulation," refers to a primary response induced by binding of a stimulatory molecule (e.g., a TCR/CD3 complex) with its cognate ligand thereby mediating a signal transduction event, such as signal transduction via the TCR/CD3 complex. Stimulation can mediate altered expression of certain molecules, such as downregulation of TGF-β, and/or reorganization of cytoskeletal structures.

The term "stimulatory molecule" refers to a molecule on a T cell that specifically binds a cognate stimulatory ligand present on an antigen presenting cell. For example, a functional signaling domain derived from a stimulatory molecule is the zeta chain associated with the T cell receptor complex. The stimulatory molecule includes a domain responsible for signal transduction.

The term "stimulatory ligand" refers to a ligand that when present on an antigen presenting cell (e.g., an APC, a dendritic cell, a B-cell, and the like.) can specifically bind with a cognate binding partner (referred to herein as a "stimulatory molecule") on a cell, for example a T cell, thereby mediating a primary response by the T cell, including activation, initiation of an immune response, proliferation, and similar processes. Stimulatory ligands are well-known in the art and encompass, inter alia, an MHC Class I molecule loaded with a peptide, an anti-CD3 antibody, a superagonist anti-CD28 antibody, and a superagonist anti-CD2 antibody.

The term "therapeutic" refers to a treatment and/or prophylaxis. A therapeutic effect is obtained by suppression, remission, or eradication of a disease state or alleviating the symptoms of a disease state.

The term "therapeutically effective amount" refers to the amount of the subject compound that will elicit the biological or medical response of a tissue, system, or subject that is being sought by the researcher, veterinarian, medical doctor or another clinician. The term "therapeutically effective amount" includes that amount of a compound that, when administered, is sufficient to prevent the development of, or alleviate to some extent, one or more of the signs or symptoms of the disorder or disease being treated. The therapeutically effective amount will vary depending on the compound, the disease and its severity and the age, weight, etc., of the subject to be treated.

The term "treat a disease" refers to the reduction of the frequency or severity of at least one sign or symptom of a disease or disorder experienced by a subject.

The term "transfected" or "transformed" or "transduced" refers to a process by which an exogenous nucleic acid is transferred or introduced into the host cell. A "transfected" or "transformed" or "transduced" cell is one which has been transfected, transformed, or transduced with exogenous nucleic acid. The cell includes the primary subject cell and its progeny.

The term "vector" refers to a polynucleotide that comprises an isolated nucleic acid and which can be used to deliver the isolated nucleic acid to the interior of a cell. Numerous vectors are known in the art including linear polynucleotides, polynucleotides associated with ionic or amphiphilic compounds, plasmids, and viruses. Thus, the term "vector" includes an autonomously replicating plasmid or a virus. The term also includes non-plasmid and non-viral compounds which facilitate the transfer of nucleic acid into cells, such as, for example, polylysine compounds, liposomes, and the like. Examples of viral vectors include adenoviral vectors, adeno-associated virus vectors, retroviral vectors, and others. For example, lentiviruses are complex retroviruses, which, in addition to the common retroviral genes gag, pol, and env, contain other genes with regulatory or structural function. Lentiviral vectors are well known in the art. Some examples of lentivirus include the Human Immunodeficiency Viruses: HIV-1, HIV-2, and the Simian Immunodeficiency Virus: SIV. Lentiviral vectors have been generated by multiply attenuating the HIV virulence genes, for example, the genes env, vif, vpr, vpu, and nef are deleted making the vector biologically safe.

Ranges: throughout this disclosure, various aspects of the disclosure can be presented in a range format. It should be understood that the description in range format is merely for convenience and brevity and should not be construed as an inflexible limitation on the scope of the disclosure. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. This applies regardless of the breadth of the range.

A "chimeric antigen receptor" (CAR) molecule is a recombinant polypeptide including at least an extracellular domain, a transmembrane domain and a cytoplasmic domain or intracellular domain. In embodiments, the domains of the CAR are on the same polypeptide chain, for example a chimeric fusion protein. In embodiments, the domains are on different polypeptide chains, for example the domains are not contiguous.

The extracellular domain of a CAR molecule includes an antigen binding domain. The antigen binding domain is for expanding and/or maintaining the modified cells, such as a CAR T cell or for killing a tumor cell, such as a solid tumor. In embodiments, the antigen binding domain for expanding and/or maintaining modified cells binds an antigen, for example, a cell surface molecule or marker, on the surface of a WBC. In embodiments, the WBC is at least one of GMP (granulocyte macrophage precursor), MDP (monocyte-macrophage/dendritic cell precursors), cMoP (common monocyte precursor), basophil, eosinophil, neutrophil, SatM (Segerate-nucleus-containing atypical monocyte), macrophage, monocyte, CDP (common dendritic cell precursor), cDC (conventional DC), pDC (plasmacytoid DC), CLP (common lymphocyte precursor), B cell, ILC (Innate Lymphocyte), NK cell, megakaryocyte, myeloblast, pro-myelocyte, myelocyte, meta-myelocyte, band cells, lymphoblast, prolymphocyte, monoblast, megakaryoblast, promegakaryocyte, megakaryocyte, platelets, or MSDC (Myeloid-derived suppressor cell). In embodiments, the WBC is a granulocyte, monocyte and or lymphocyte. In embodiments, the WBC is a lymphocyte, for example, a B cell. In embodiments, the WBC is a B cell. In embodiments, the cell surface molecule of a B cell includes CD19, CD22, CD20, BCMA, CD5, CD7, CD2, CD16, CD56, CD30, CD14, CD68, CD11b, CD18, CD169, CD1c, CD33, CD38, CD138, or CD13. In embodiments, the cell surface molecule of the B cell is CD19, CD20, CD22, or BCMA. In embodiments, the cell surface molecule of the B cell is CD19.

The cells described herein, including modified cells such as CAR cells and modified T cells can be derived from stem cells. Stem cells may be adult stem cells, embryonic stem cells, more particularly non-human stem cells, cord blood stem cells, progenitor cells, bone marrow stem cells, induced pluripotent stem cells, totipotent stem cells or hematopoietic stem cells. A modified cell may also be a dendritic cell, a NK-cell, a B-cell or a T cell selected from the group consisting of inflammatory T-lymphocytes, cytotoxic T-lymphocytes, regulatory T lymphocytes or helper T-lymphocytes. In embodiments, Modified cells may be derived from the group consisting of CD4+ T lymphocytes and CD8+ T lymphocytes. Prior to expansion and genetic modification of the cells, a source of cells may be obtained from a subject through a variety of non-limiting methods. T cells may be obtained from a number of non-limiting sources, including peripheral blood mononuclear cells, bone marrow, lymph node tissue, cord blood, thymus tissue, tissue from a site of infection, ascites, pleural effusion, spleen tissue, and tumors. In embodiments, any number of T cell lines available and known to those skilled in the art, may be used. In embodiments, modified cells may be derived from a healthy donor, from a patient diagnosed with cancer or from a patient diagnosed with an infection. In embodiments, a modified cell is part of a mixed population of cells which present different phenotypic characteristics.

A population of cells refers to a group of two or more cells. The cells of the population could be the same, such that the population is a homogenous population of cells. The cells of the population could be different, such that the population is a mixed population or a heterogeneous population of cells. For example, a mixed population of cells could include modified cells comprising a first CAR and cells comprising a second CAR, wherein the first CAR and the second CAR bind different antigens.

The term "stem cell" refers to any of certain types of cell which have the capacity for self-renewal and the ability to differentiate into other kind(s) of cell. For example, a stem cell gives rise either to two daughter stem cells (as occurs in vitro with embryonic stem cells in culture) or to one stem cell and a cell that undergoes differentiation (as occurs e.g. in hematopoietic stem cells, which give rise to blood cells). Different categories of stem cells may be distinguished on the basis of their origin and/or on the extent of their capacity for differentiation into other types of cell. For example, stem cells may include embryonic stem (ES) cells (i.e., pluripotent stem cells), somatic stem cells, induced pluripotent stem cells, and any other types of stem cells.

The pluripotent embryonic stem cells are found in the inner cell mass of a blastocyst and have an innate capacity for differentiation. For example, pluripotent embryonic stem cells have the potential to form any type of cell in the body. When grown in vitro for long periods of time, ES cells maintain pluripotency as progeny cells retain the potential for multilineage differentiation.

Somatic stem cells can include fetal stem cells (from the fetus) and adult stem cells (found in various tissues, such as bone marrow). These cells have been regarded as having a capacity for differentiation that is lower than that of the pluripotent ES cells—with the capacity of fetal stem cells being greater than that of adult stem cells. Somatic stem cells apparently differentiate into only a limited number of types of cells and have been described as multipotent. The "tissue-specific" stem cells normally give rise to only one type of cell. For example, embryonic stem cells may be differentiated into blood stem cells (e.g., Hematopoietic stem cells (HSCs)), which may be further differentiated into various blood cells (e.g., red blood cells, platelets, white blood cells, etc.).

Induced pluripotent stem cells (i.e., iPS cells or iPSCs) may include a type of pluripotent stem cell artificially derived from a non-pluripotent cell (e.g., an adult somatic cell) by inducing an expression of specific genes. Induced pluripotent stem cells are similar to natural pluripotent stem cells, such as embryonic stem (ES) cells, in many aspects, such as the expression of certain stem cell genes and proteins, chromatin methylation patterns, doubling time, embryoid body formation, teratoma formation, viable chimera formation, and potency and differentiability. Induced pluripotent cells can be obtained from adult stomach, liver, skin, and blood cells.

In embodiments, the antigen binding domain for killing a tumor, binds an antigen on the surface of a tumor, for example a tumor antigen or tumor marker. Tumor antigens are proteins that are produced by tumor cells that elicit an immune response, particularly T cell mediated immune responses. Tumor antigens are well known in the art and include, for example, tumor associated MUC1 (tMUC1), a glioma-associated antigen, carcinoembryonic antigen (CEA), β-human chorionic gonadotropin, alphafetoprotein (AFP), lectin-reactive AFP, thyroglobulin, RAGE-1, MN-CA IX, human telomerase reverse transcriptase, RU1, RU2 (AS), intestinal carboxyl esterase, mut hsp70-2, M-CSF, prostase, prostate-specific antigen (PSA), PAP, NY-ESO-1, LAGE-1a, p53, prostein, PSMA, Her2/neu, surviving, telomerase, prostate-carcinoma tumor antigen-1 (PCTA-1), MAGE, ELF2M, neutrophil elastase, ephrinB2, CD22, insulin growth factor (IGF)-I, IGF-II, IGF-I receptor, CD19, and mesothelin. For example, when the tumor antigen is CD19, the CAR thereof can be referred to as CD19 CAR (19CAR, CD19CAR, or CD19-CAR) which is a CAR molecule that includes an antigen binding domain that binds CD19.

In embodiments, the extracellular antigen binding domain of a CAR includes at least one scFv or at least a single domain antibody. As an example, there can be two scFvs on a CAR. The scFv includes a light chain variable (VL) region and a heavy chain variable (VH) region of a target antigen-specific monoclonal antibody joined by a flexible linker. Single chain variable region fragments can be made by linking light and/or heavy chain variable regions by using a short linking peptide (Bird et al., Science 242:423-426, 1988). An example of a linking peptide is the GS linker having the amino acid sequence $(GGGGS)_3$ (SEQ ID NO: 118), which bridges approximately 3.5 nm between the carboxy terminus of one variable region and the amino terminus of the other variable region. Linkers of other sequences have been designed and used (Bird et al., 1988, supra). In general, linkers can be short, flexible polypeptides and preferably comprised of about 20 or fewer amino acid residues. The single chain variants can be produced either recombinantly or synthetically. For synthetic production of scFv, an automated synthesizer can be used. For recombinant production of scFv, a suitable plasmid containing polynucleotide that encodes the scFv can be introduced into a suitable host cell, either eukaryotic, such as yeast, plant, insect or mammalian cells, or prokaryotic, such as *E. coli*. Polynucleotides encoding the scFv of interest can be made by routine manipulations such as ligation of polynucleotides. The resultant scFv can be isolated using standard protein purification techniques known in the art.

The cytoplasmic domain of the CAR molecules described herein includes one or more co-stimulatory domains and one or more signaling domains. The co-stimulatory and signaling domains function to transmit the signal and activate molecules, such as T cells, in response to antigen binding. The one or more co-stimulatory domains are derived from stimulatory molecules and/or co-stimulatory molecules, and the signaling domain is derived from a primary signaling domain, such as the CD3 zeta domain. In embodiments, the signaling domain further includes one or more functional signaling domains derived from a co-stimulatory molecule. In embodiments, the co-stimulatory molecules are cell surface molecules (other than antigens receptors or their ligands) that are required for activating a cellular response to an antigen.

In embodiments, the co-stimulatory domain includes the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or any combination thereof. In embodiments, the signaling domain includes a CD3 zeta domain derived from a T cell receptor.

The CAR molecules described herein also include a transmembrane domain. The incorporation of a transmembrane domain in the CAR molecules stabilizes the molecule.

In embodiments, the transmembrane domain of the CAR molecules is the transmembrane domain of a CD28 or 4-1BB molecule.

Between the extracellular domain and the transmembrane domain of the CAR, there may be incorporated a spacer domain. As used herein, the term "spacer domain" generally means any oligo- or polypeptide that functions to link the transmembrane domain to the extracellular domain and/or the cytoplasmic domain on the polypeptide chain. A spacer domain may include up to 300 amino acids, preferably 10 to 100 amino acids, and most preferably 25 to 50 amino acids.

The present disclosure describes a method for in vitro cell preparation, the method comprising: preparing cells; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a population of modified cells, wherein the first antigen is different from the second antigen.

The present disclosure also describes a method for enhancing cell capabilities (e.g., expansion) in a subject having cancer, the method comprising: obtaining cells from the subject or a healthy donor; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a population of modified cells; and administering an effective amount of modified cells to the subject, wherein: the first antigen is different from the second antigen; and the level of cell capabilities (e.g., expansion) in the subject is higher than the level of cell capabilities (e.g., expansion) in a subject administered with an effective amount of cells that have been contacted with the first vector but not the second vector.

As defined herein, cell capabilities comprise capabilities or functional properties of the cells, including lymphocytes (e.g., T cells and NK cells). T cell capabilities may comprise, for example, proliferative capabilities (expansion), cytokine production capabilities, trafficking capabilities, memory-like cell maintenance capabilities, and less-exhaustion capabilities. Increase of these capabilities may enhance these cells' capabilities to inhibit tumor growth, maintain persistence in blood of a subject having cancer and/or tumor microenvironment, infiltrate tumor microenvironment, and maintain memory-like status before contacting target antigens. In embodiments, maintaining the cells includes maintaining the capabilities of the cells, maintaining the phenotypes of the cells, maintaining the numbers of cells, or a combination thereof.

The present disclosure also describes a method for enhancing cell persistence in a subject having cancer, the method comprising: obtaining cells from the subject or a healthy donor; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a population of modified cells; and administering an effective amount of modified cells to the subject, wherein: the first antigen is different from the second antigen; and the level of cell persistence in the subject is higher than the level of cell persistence in a subject administered with an effective amount of cells that have been contacted with the first vector but not the second vector.

The present disclosure also describes a method for treating a subject having cancer, the method comprising: obtaining cells from the subject or a healthy donor; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a population of modified cells; and administering an effective amount of modified cells to the subject, wherein: the first antigen is different form the second antigen.

The present disclosure also describes a method for enhancing treatment of a subject having cancer, the method comprising: obtaining cells from the subject or a healthy donor; contacting the cells with (1) a first vector comprising a polynucleotide encoding a first antigen binding molecule that binds a first antigen and (2) a second vector comprising a polynucleotide encoding a second antigen binding molecule that binds a second antigen to obtain a population of modified cells; and administering an effective amount of modified cells to the subject, wherein: the first antigen is different from the second antigen; and the level of inhibition of tumor growth by the effective amount of modified cells is higher than the level of inhibition of tumor growth by the effective amount of cells that have been contacted with the second vector but not the first vector.

The present disclosure also describes a method for in vitro cell preparation, the method comprising: introducing a first vector comprising a polynucleotide encoding a first antigen binding molecule that binds a first antigen into a first population of cells; introducing a second vector comprising a polynucleotide encoding a second antigen binding molecule that binds a second antigen into a second population of cells; and culturing the first and second population of cells, wherein the first antigen is different from the second antigen.

The present disclosure also describes a method for in vitro cell preparation, the method comprising: introducing a first vector comprising a polynucleotide encoding a first antigen binding molecule that binds a first antigen into a first population of cells; introducing a second vector comprising a polynucleotide encoding a second antigen binding molecule that binds a second antigen into a second population of cells; and culturing the first and second population of cells in the presence of a presenting cell comprising the first antigen (expressing or physically squeezed), wherein the first antigen is different from the second antigen.

The present disclosure also describes a method for enhancing cell capabilities (e.g., expansion) in a subject having cancer, the method comprising: introducing a first vector comprising a polynucleotide encoding a first antigen binding molecule that binds a first antigen into a first population of cells to obtain a first population of modified cells; introducing a second vector comprising a polynucleotide encoding a second antigen binding molecule that binds a second antigen into a second population of cells to obtain a second population of modified cells; and administering an effective amount of the first and second population of modified cells to the subject, wherein: the first antigen is different from the second antigen; and the level of cell capabilities (e.g., expansion) in the subject is higher than the level of cell capabilities (e.g., expansion) in a subject administered an effective amount of the second population of modified cells but not the first population of modified cells.

The present disclosure also describes a method for treating a subject having cancer, the method comprising: introducing a first vector comprising a polynucleotide encoding a first antigen binding molecule that binds a first antigen into a first population of cells to obtain a first population of modified cells; introducing a second vector comprising a polynucleotide encoding a second antigen binding molecule that binds a second antigen into a second population of cells to obtain a second population of modified cells; and administering an effective amount of the first and second population of modified cells to the subject, wherein: the first antigen is different from the second antigen.

The present disclosure also describes a method for enhancing treatment of a subject having cancer, the method comprising: introducing a first vector comprising a polynucleotide encoding a first antigen binding molecule that binds a first antigen into a first population of cells to obtain a first population of modified cells; introducing a second vector comprising a polynucleotide encoding a second antigen binding molecule that binds a second antigen into a second population of cells to obtain a second population of modified cells; and administering an effective amount of the first and second population of modified cells to the subject, wherein: the first antigen is different from the second antigen; and the level of inhibition of tumor growth in the subject by the effective amount of first population of modified cells is higher than the level of inhibition of tumor growth in the subject by the effective amount of the second population of modified cells that is not administered the first population of modified cells.

The present disclosure also describes a method for enhancing T cell response, the method comprising: introducing a first vector comprising a polynucleotide encoding a first antigen binding molecule that binds a first antigen into a first population of cells; introducing a second vector comprising a polynucleotide encoding a second antigen binding molecule that binds a second antigen into a second population of cells; contacting cells expressing the second antigen with the first population of cells and the second population of cells; and measuring a level of the T cell response, wherein the level is higher than a level of the T cell response in response to the cells contacted with the second population of cells without the first population.

The present disclosure also describes a method for enhancing T cell response, the method comprising: contacting a population of cells with a first vector comprising a polynucleotide encoding a first antigen binding molecule that binds a first antigen and a second vector comprising a polynucleotide encoding a second antigen binding molecule that binds a second antigen to obtain a population of modified cells; contacting cells expressing the second antigen with a population of modified cells; and measuring the level of the T cell response, wherein the level of T cell response is higher than the level of T cell response in cells contacted with the population of cells that have been contacted with the second vector but not the first vector.

The present disclosure also describes a pharmaceutical composition comprising: a first population of cells comprising a CAR comprising a scFv binding CD19, the first population of cells comprising one or more polynucleotides encoding at least one of IL-12, IL-6, and IFNγ; and a second population of cells comprising a CAR comprising a scFv binding GUCY2C.

The present disclosure also describes a method of cause T cell response in a subject having CRC and/or treating the subject, the method comprising administering an effective amount of a pharmaceutical composition comprising: a first population of cells comprising a CAR comprising a scFv binding CD19, the first population of cells comprising one or more polynucleotides encoding at least one of IL-12, IL-6, and IFNγ; and a second population of cells comprising a CAR comprising a scFv binding GUCY2C to the subject.

The cells include macrophages, dendritic cells, or lymphocytes such as T cells or NK cells. In embodiments, the cells are T cells. In embodiments, the first antigen binding molecule binds a cell surface molecule of a WBC. In embodiments, the WBC is a granulocyte, a monocyte, or lymphocyte. In embodiments, the WBC is a B cell. In embodiments, the cell surface molecule of the WBC is CD19, CD22, CD20, BCMA, CD5, CD7, CD2, CD16, CD56, CD30, CD14, CD68, CD11 b, CD18, CD169, CD1c, CD33, CD38, CD138, or CD13. In embodiments, the cell surface molecule of the WBC is CD19, CD20, CD22, or BCMA. In embodiments, the cell surface molecule of the WBC is CD19.

In embodiments, the second antigen binding molecule binds a solid tumor antigen. In embodiments, the solid tumor antigen is tumor associated MUC1 (tMUC1), PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, CLDN 18.2, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, MAGE A4, or EGFR.

In embodiments, the first and second binding molecules are CARs. In embodiments, the CAR comprises an extracellular domain, a transmembrane domain, and an intracellular domain, and the extracellular domain binds a tumor antigen. In embodiments, the intracellular domain comprising a co-stimulatory domain comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof. In embodiments, the intracellular domain comprises a CD3 zeta signaling domain.

In embodiments, the first binding molecule is a CAR, and the second binding molecule is TCR. In embodiments, the T cell comprises a modified T Cell Receptor (TCR). In embodiments, the TCR is derived from spontaneously occurring tumor-specific T cells in patients. In embodiments, the TCR binds a tumor antigen. In embodiments, the tumor antigen comprises CEA, gp100, MART-1, p53, MAGE-A3, or NY-ESO-1. In embodiments, the TCR comprises TCRγ and TCRδ chains, or TCRα and TCRβ chains, or a combination thereof.

In embodiments, the second population of cells are derived from tumor-infiltrating lymphocytes (TILs). In embodiments, a T cell clone that expresses a TCR with a high affinity for the target antigen may be isolated. TILs or peripheral blood mononuclear cells (PBMCs) can be cultured in the presence of antigen-presenting cells (APCs) pulsed with a peptide representing an epitope known to elicit a dominant T cell response when presented in the context of a defined HLA allele. High-affinity clones may be then selected on the basis of MHC-peptide tetramer staining and/or the ability to recognize and lyse target cells pulsed with low titrated concentrations of cognate peptide antigen. After the clone has been selected, the TCRα and TCRβ chains or TCRγ and TCRδ chains are identified and isolated by molecular cloning. For example, for TCRα and TCRβ chains, the TCRα and TCRβ gene sequences are then used to generate an expression construct that ideally promotes stable, high-level expression of both TCR chains in human T cells. The transduction vehicle, for example, a gammaretrovirus or lentivirus, can then be generated and tested for functionality (antigen specificity and functional avidity) and used to produce a clinical lot of the vector. An aliquot of the final product can then be used to transduce the target T cell population (generally purified from patient PBMCs), which is expanded before infusion into the patient.

Various methods may be implemented to obtain genes encoding tumor-reactive TCR. More information is provided in Kershaw et al., Clin Transl Immunology. 2014 May; 3(5): e16. In embodiments, specific TCR can be derived from spontaneously occurring tumor-specific T cells in patients. Antigens included in this category include the melanocyte differentiation antigens MART-1 and gp100, as well as the MAGE antigens and NY-ESO-1, with expression in a broader range of cancers. TCRs specific for viral-associated malignancies can also be isolated, as long as viral proteins are expressed by transformed cells. Malignancies in this category include liver and cervical cancer, those associated with hepatitis and papilloma viruses, and Epstein-Barr virus-associated malignancies. In embodiments, target antigens of the TCR include CEA (e.g., for colorectal cancer), gp100, MART-1, p53 (e.g., for melanoma), MAGE-A3 (e.g., melanoma, esophageal and synovial sarcoma), and NY-ESO-1 (e.g., for nelanoma and sarcoma as well as multiple myelomas).

In embodiments, preparation and transfusion of tumor infiltrating lymphocytes (TIL) may be implemented in the following manner. For example, tumor tissue coming from surgical or biopsy specimens, can be obtained under aseptic conditions and transported to the cell culture chamber in ice box. Necrotic tissue and adipose tissue can be removed. The tumor tissue can be cut into small pieces of about 1-3 cubic millimeter. Collagenase, hyaluronidase and DNA enzyme can be added, and digested overnight at 4° C. Filtering with 0.2 um filter, cells can be separated and collected by lymphocyte separation fluid, under 1500 rpm for 5 min. Expanding the cells in a culture medium comprising PHA, 2-mercaptoethanol, and CD3 monoclonal antibody, and a small dose of IL-2 (10-20 IU/ml) may be added to induce activation and proliferation. The cell density may be carefully measured and maintained within the range of 0.5-2×$10^6$/ml for 7-14 days at a temperature of 37° C. with 5% $CO_2$. TIL positive cells having the ability to kill homologous cancer cell can be screened out by co-culture. The TIL positive cells can be amplified in a serum-free medium containing a high dose of IL-2 (5000-6000 IU/ml) until greater than $1\times10^{11}$ TILs can be obtained. To administer TILs, they are first collected in saline using continuous-flow centrifugation and then filtered through a platelet-administration set into a volume of 200-300 mL containing 5% albumin and 450000 IU of IL-2. The TILs can be infused into patients through a central venous catheter over a period of 30-60 minutes. In embodiments, TILs can be infused in two to four separate bags, and the individual infusions can be separated by several hours.

In embodiments, the population of modified cells comprise cells comprising the first binding molecule and cells comprising the second binding molecules. In embodiments, the population of modified cells comprise cells comprising the first binding molecule, cells comprising the second binding molecules, and cells comprising both the first binding molecule and the second binding molecule.

In embodiments, the increase in T cell response is based on the increase in the number of copies of CAR(s) and/or the amount of cytokine released (e.g., IL-6 and IFN-γ. In embodiments, the T cell response comprises cytokine releases, cell expansion, cell persistence, and/or activation levels. In embodiments, the first vector further comprises a polynucleotide encoding IL-6 or IFNγ, or a combination thereof. In embodiments, the first vector further comprises a polynucleotide encoding IL-12. In embodiments, the polynucleotide comprises a polynucleotide encoding NFAT and/or VHL. In embodiments, the population of modified cells comprises cells expressing the first binding molecule and IL-6 or IFNγ, or a combination thereof, cells expressing the second binding molecules, cells expressing the first and second molecules, and/or cells expressing the first binding molecule and IL-12. In embodiments, the population of modified cells comprises cells expressing the second binding molecule and IL-6 or IFNγ, or a combination thereof, cells expressing the second binding molecules, cells expressing the first and second molecules, and/or cells expressing the first binding molecule and IL-12. In embodiments, the population of modified cells comprises cells expressing the second binding molecule and IL-6 or IFNγ, or a combination thereof, cells expressing the second binding molecules, cells expressing the first and second molecules, and/or cells expressing the second binding molecule and IL-12. In embodiments, the population of modified cells comprises cells expressing a dominant negative form of PD-1.

The present disclosure describes nucleic acids encoding at least two different antigen binding domains. In embodiments, there is a first antigen binding domain that binds an antigen on the surface of a WBC, and there is a second antigen binding domain that binds an antigen on a tumor that is different from the antigen on the surface of a WBC. The first antigen binding domain functions to expand the cells that it is introduced into, while the second antigen binding domain functions to inhibit the growth of or kill tumor cells containing the target tumor antigen upon binding to the target antigen. In embodiments, a nucleic acid described herein encodes both the first and second antigen binding domains on the same nucleic acid molecule. In embodiments, the two antigen binding domains are encoded by two separate nucleic acid molecules. For example, a first nucleic acid encodes a first antigen binding domain and a second nucleic acid encodes a second antigen binding domain.

In embodiments, the present disclosure describes nucleic acids encoding a first antigen binding domain of a binding molecule and a second antigen binding domain of a binding molecule, wherein the first antigen binding domain binds a cell surface molecule of a WBC, and the second antigen binding domain binds an antigen different from the cell surface molecule of the WBC. In embodiments, the first antigen binding domain binds a cell surface antigen of a B cell or a B cell marker. In embodiments, the second binding domain does not bind a B cell marker. In embodiments, the second binding domain includes a scFv comprising an amino acid sequence of SEQ ID NO: 255 or 256. For example, the second antigen binding domain is on a CAR having one of the amino acid sequences of SEQ ID NOs: 258-264.

In embodiments, the first and second antigen binding domains are on two different binding molecules (first and second binding molecules) such as a first CAR and a second CAR. As an example, a first CAR includes an extracellular binding domain that binds a marker on the surface of a B cell, and a second CAR includes an extracellular binding domain that binds a target antigen of a tumor cell. In embodiments, the first CAR and second CAR are encoded by different nucleic acids. In embodiments, the first CAR and second CAR are two different binding molecules but are encoded by a single nucleic acid.

In embodiments, the two different antigen binding domains can be on the same binding molecule, for example on a bispecific CAR, and encoded by a single nucleic acid. In embodiments, the bispecific CAR can have two different scFv molecules joined together by linkers.

A bispecific CAR (or tandem CAR (tanCAR)) may include two binding domains: scFv1 and scFv2. More information about the bispecific CAR can be found at PCT Patent Application NO: PCT/US2020/013099, which is incorporated herein by its reference. In embodiments, the two different antigen binding domains can be on a CAR and a T cell receptor (TCR) and are encoded by separate nucleic acids. The binding domain of a TCR can target a specific tumor antigen or tumor marker on the cell of a tumor. In embodiments the TCR binding domain is a TCR alpha binding domain or TCR beta binding domain that targets a specific tumor antigen. In embodiments, the TCR comprises the TCRγ and TCRδ chains or the TCRα and TCRβ chains.

The present disclosure also describes vectors including the nucleic acids described herein. In embodiments, a single vector contains the nucleic acid encoding the first CAR and second CAR or TCR (containing the second antigen binding domain). In embodiments, a first vector contains the first nucleic acid encoding a first CAR, and a second vector contains the nucleic acid encoding the second CAR or TCR. In embodiments, the vector includes the nucleic acid encoding a bispecific CAR including at least the two different antigen binding domains. In embodiments, the vectors including the nucleic acids described herein are lentiviral vectors.

Moreover, the present disclosure describes modified cells comprising the nucleic acids or vectors described herein. The cells have been introduced with the nucleic acids or vectors described herein and express at least one or more different antigen binding domains. In embodiments, the cells express one antigen binding domain. In embodiments, the cells include a first antigen binding domain and a second antigen binding domain, wherein the first antigen binding domain binds a cell surface molecule of a WBC, and the second antigen binding domain binds an antigen different from the cell surface molecule of a WBC. In embodiments, the second antigen binding domain binds a tumor antigen. In embodiments, the cells are modified T cells. In embodiments, the modified T cells are CAR T cells including one or more nucleic acids encoding a first antigen binding domain and/or a second antigen binding domain. In embodiments, the modified cells include T cells containing a TCR including the second antigen binding domain.

Further, the present disclosure describes compositions including a mixed population of the modified cells described herein. In embodiments, the modified cells include modified lymphocytes, modified dendritic cells, and modified macrophages. In embodiments, the modified lymphocytes are modified T cells or modified NK cell. In embodiments, the modified T cells are CAR T cells.

The present disclosure describes a mixed population of modified cells effective for expanding and/or maintaining the modified cells in a patient. In embodiments, examples of a mixed population of modified cells include the following: (1) a first modified cell expressing an antigen binding domain for expanding and/or maintaining the modified cells and a second modified cell expressing an antigen binding domain for killing a target cell, such as a tumor cell; (2) the modified cells of (1) and a further modified cell expressing at least two different antigen binding domains, a first antigen binding domain for expanding and/or maintaining the modified cells and a second antigen binding domain for killing a target cell (wherein the two different antigen binding domains are expressed on the same cell); (3) a modified cell expressing at least two different antigen binding domains, a first antigen binding domain for expanding and/or maintaining the modified cells and a second antigen binding domain for killing a target cell (wherein the two different antigen binding domains are expressed on the same cell); (4) a modified cell expressing an antigen binding domain for killing a target cell and a modified cell expressing at least two antigen binding domains, a first antigen binding domain for expanding and/or maintaining the modified cells and a second antigen binding domain for killing a target cell (wherein the two different antigen binding domains are expressed on the same modified cell); or (5) a modified cell expressing an antigen binding domain for expanding and/or maintaining the modified cells and a modified cell expressing at least two antigen binding domains, a first antigen binding domain for expanding and/or maintaining the modified cells and a second antigen binding domain for killing a target cell (wherein the two different antigen binding domains are expressed on the same modified cell). In embodiments, the two antigen binding domains are different molecules. In embodiments, the antigen binding domain for expanding the modified cells (the first antigen binding domain) is an antigen binding domain that binds a WBC, such as a B cell, and the antigen binding domain for killing a target cell, such as tumor cell, (the second antigen binding domain) is an antigen binding domain that binds a tumor. In embodiments, the antigen binding domain binding a B cell binds the surface antigen of the B cell, for example, CD19, and the antigen binding domain binding a tumor binds an antigen of a tumor, for example tMUC1. In embodiments, the tumor cell is a solid tumor cell.

In embodiments, the mixed population of modified cells may include at least one of the following modified cells: a first modified cell expressing an antigen binding domain for expanding and/or maintaining the modified cells, a second modified cell expressing an antigen binding domain for killing a target cell, such as a tumor cell, and a third modified cell expressing both the antigen binding domain for expanding and/or maintaining the modified cells and the antigen binding domain for killing a target cell. For example, the mixed population of modified cells includes the first and second modified cells, the first and third modified cells, or the second and third modified cells. In embodiments, the first modified cell expresses a CAR binding an antigen of WBC (e.g., CD19); the second modified cell expresses a CAR or TCR binding a solid tumor antigen; and the third modified cell expresses the CAR binding the antigen of WBC and the CAR/TCR binding the solid tumor antigen. It has been reported that persistent antigen exposure can cause T cell exhaustion. Thus, a population of modified cells including the third modified cell can exhaust at a higher rate than the mixed population of modified cells. For example, the population of modified cells including the third modified cell alone can exhaust at a higher rate than the mixed population of modified cells including the first and the second modified cells in the presence of the antigen of WBC. Examples of the solid tumor antigens of TCR comprise one or more of TPO, TGM3, TDGF1, TROP2, LY6K, TNFSF13B, HEG1, LY75, HLA-G, CEACAM8, CEACAM6, EPHA2, GPRC5D, PLXDC2, HAVCR1, CLEC12A, CD79B, OR51E2, CDH17, IFITM1, MELTF, DRS, SLC6A3, ITGAM, SLC44A1, RHOC, CD109, ABCG2, ABCA10, ABCG8, 5t4, HHLA2, PRAME, CDH6, ESR1, SLC2A1, GJA5, ALPP, FGD2, PMEL, CYP19A1, MLANA, STEAP1, SSX2, PLAC1, ANKRD30A, CPA2, TTN, ZDHHC23, ARPP21, RBPMS, PAX5, MIA, CIZ1, AMACR, BAP31, IDO1, PGR, RAD51, USP17L2, OLAH, IGF2BP3, STS, IGF2, ACTA1, MAGE A4, or CTAG1.

The mixed population of modified cells described herein includes about 1% to 10% modified cells expressing the first antigen binding domain, 50% to 60% modified cells expressing a second antigen binding domain, and about 10% modified cells expressing both the first antigen binding domain and the second antigen binding domain (wherein the first and second antigen binding domains are expressed in a single cell).

The present disclosure also describes methods of culturing cells described herein. The methods described herein include obtaining a cell comprising a first antigen binding domain and/or a second antigen binding domain, wherein the first antigen binding domain binds a cell surface molecule of a WBC, and the second antigen binding domain binds an antigen different from the cell surface molecule of the WBC; and culturing the cell in the presence of an agent derived from a cell surface molecule of the WBC or from an antigen to which the second antigen binding domain binds. In embodiments, the agent is an extracellular domain of a cell surface molecule of a WBC.

The present disclosure also describes methods of culturing mixed population of cells described herein. The methods described herein include obtaining a mixed population of cells comprising a first antigen binding domain and/or a second antigen binding domain, wherein the first antigen binding domain binds a cell surface molecule of a WBC, and the second antigen binding domain binds an antigen different from the cell surface molecule of the WBC; and culturing the cells in the presence of an agent derived from a cell surface molecule of the WBC or from an antigen to which the second antigen binding domain binds. In embodiments, the agent is an extracellular domain of a cell surface molecule of a WBC.

The present disclose describes methods for in vitro cell preparation, wherein the method includes providing cells; introducing one or more nucleic acids described herein encoding a first antigen binding domain and/or a second antigen binding domain into the cells, wherein the first antigen binding domain binds a cell surface molecule of a WBC, and the second antigen binding domain binds an antigen different from the cell surface molecule of the WBC; and culturing the cells in the presence of an agent derived from the cell surface molecule of the WBC or from an antigen to which the second antigen binding domain binds. The methods provide genetically modified cells including a first antigen binding domain, cells including a second binding domain, and cells including both the first and second antigen binding domain. The methods provide cells with single binding domains and cells expressing both antigen binding domains. The methods also provide a mixed population of cells including cells including a single binding domain and cells expressing both antigen binding domains. Additionally, the methods provide compositions including a mixed population of cells described herein.

The present disclosure describes using the prepared cell preparation, the mixed population of cells, or the compositions of mixed population of cells to enhance and maintain the T cell capabilities (e.g., expansion) in a subject having cancer, in order to be effective in killing the tumorigenic cells in the subject. In embodiments, the method comprises introducing a plurality of nucleic acids described herein into T cells to obtain a mixed population of modified T cells, the plurality of nucleic acids encoding a chimeric antigen receptor (CAR) or TCR binding a solid tumor antigen and/or encoding a CAR binding an antigen of a WBC; and administering an effective amount of a mixed population of modified cells to the subject, wherein examples of a mixed population of modified cells include the following: (1) T cells containing a CAR or TCR binding a solid tumor antigen and T cells containing a CAR binding an antigen of a WBC; (2) the T cells of (1) and further T cells containing both (i) a CAR or TCR binding a solid tumor antigen, and (ii) a CAR binding an antigen of a WBC (both (i) and (ii) are in a single modified T cell); (3) T cells containing both (i) the CAR or TCR binding a solid tumor antigen, and (ii) a CAR binding an antigen of a WBC (both (i) and (ii) are in a single modified T cell); (4) T cells containing a CAR or TCR binding a solid tumor antigen and T cells containing both (i) a CAR or TCR binding a solid tumor antigen and (ii) a CAR binding an antigen of a WBC (both (i) and (ii) are in a single modified T cell); or (5) T cells containing a CAR binding an antigen of a WBC and T cells containing both (i) a CAR or TCR binding a solid tumor antigen and (ii) a CAR binding an antigen of a WBC (both (i) and (ii) are in a single modified T cell). In embodiments, the WBC is a B cell. Additionally, the present disclosure describes methods for introducing and/or enhancing lymphocyte (T cell) response in a subject wherein the response is to a therapeutic agent (e.g., cytokines) or a therapy for treating the subject. Embodiments described herein involve a mechanism that expands and/or maintains the lymphocytes and a mechanism that relates to binding of a CAR to a tumor cell. In embodiments, the first mechanism involves a molecule involved in expanding and/or maintaining the lymphocytes in a subject, and an additional mechanism involves a molecule directed to inhibiting the growth of, or the killing of a tumor cell in the subject. In embodiments, the mechanisms involve signal transduction and molecules or domains of a molecules responsible for signal transduction are involved in the mechanisms described herein. For example, the first mechanism includes a CAR binding an antigen associated with blood, such as blood cells and blood plasma, or non-essential tissues, and the additional mechanism includes a CAR or TCR targeting an antigen associated with the tumor cell. Examples of non-essential tissues include the mammary gland, colon, gastric gland, ovary, blood components (such as WBC), and thyroid. In embodiments, the first mechanism involves a first antigen binding domain of a molecule, and the additional mechanism involves a second antigen binding domain of a molecule. In embodiments, the first mechanism and the additional mechanism are performed by a mixed population of modified cells. In embodiments, the mechanism involves a cell expressing an antigen associated with a tumor cell, and the additional mechanism involves a lymphocyte, such as a B cell, expressing a cell surface antigen. In embodiments, the CAR binding a solid tumor antigen is a bispecific CAR. In embodiments, the CAR binding an antigen of WBC is a bispecific CAR.

The methods described herein involves lymphocytes expressing an expansion molecule and a function molecule. In embodiments, the expansion molecule expands and/or maintains the lymphocytes in a subject, and the function molecule inhibits the growth of or kills a tumor cell in the subject. In embodiments, the expansion molecule and the function molecule are on a single CAR molecule, for example a bispecific CAR molecule. In embodiments, the expansion molecule and the function molecule are on separate molecules, for example, CAR and TCR or two different CARs. The expansion molecule can include a CAR binding to an antigen associated with blood (e.g., blood cells and blood plasma) or non-essential tissues, and the function molecule can include a CAR or TCR targeting an antigen associated with a tumor cell.

Lymphocyte or T cell response in a subject refers to cell-mediated immunity associated with a helper, killer, regulatory, and other types of T cells. For example, T cell response may include activities such as assisting other WBCs in immunologic processes and identifying and destroying virus-infected cells and tumor cells. T cell response in the subject can be measured via various indicators such as a number of virus-infected cells and/or tumor cells that T cells kill, the amount of cytokines (e.g., IL-6 and IFN-γ) that T cells release in vivo and/or in co-culturing with virus-infected cells and/or tumor cells, indicates a level of proliferation of T cells in the subject, a phenotype change of T cells, for example, changes to memory T cells, and a level longevity or lifetime of T cells in the subject.

In embodiments, the method of enhancing T cell response described herein can effectively treat a subject in need thereof, for example, a subject diagnosed with a tumor. The term tumor refers to a mass, which can be a collection of fluid, such as blood, or a solid mass. A tumor can be malignant (cancerous) or benign. Examples of blood cancers include chronic lymphocytic leukemia, acute myeloid leukemia, acute lymphoblastic leukemia, and multiple myeloma.

Solid tumors usually do not contain cysts or liquid areas. The major types of malignant solid tumors include sarcomas and carcinomas. Sarcomas are tumors that develop in soft tissue cells called mesenchymal cells, which can be found in blood vessels, bone, fat tissues, ligament lymph vessels, nerves, cartilage, muscle, ligaments, or tendon, while carcinomas are tumors that form in epithelial cells, which are found in the skin and mucous membranes. The most common types of sarcomas include undifferentiated pleomorphic sarcoma which involves soft tissue and bone cells; leiomyosarcoma which involves smooth muscle cells that line blood vessels, gastrointestinal tract, and uterus; osteosarcoma which involves bone cells, and liposarcoma which involves fat cells. Some examples of sarcomas include Ewing sarcoma, Rhabdomyosarcoma, chondosarcoma, mesothelioma, fibrosarcoma, fibrosarcoma, and glioma.

The five most common carcinomas include adrenocarcinoma which involves organs that produce fluids or mucous, such as the breasts and prostate; basal cell carcinoma which involves cells of the outer-most layer of the skin, for example, skin cancer; squamous cell carcinoma which involves the basal cells of the skin; and transitional cell carcinoma which affects transitional cells in the urinary tract which includes the bladder, kidneys, and ureter. Examples of carcinomas include cancers of the thyroid, breast, prostate, lung, intestine, skin, pancreas, liver, kidneys, and bladder, and cholangiocarcinoma.

The methods described herein can be used to treat a subject diagnosed with cancer. The cancer can be a blood cancer or can be a solid tumor, such as a sarcoma or carcinoma. The method of treating includes administering an effective amount of a mixed population of T cells described herein comprising a first antigen binding domain and/or a second antigen binding domain to the subject to provide a T-cell response, wherein the first antigen binding domain binds a cell surface molecule of a WBC, and the second antigen binding domain binds an antigen different from the cell surface molecule of the WBC. In embodiments, enhancing the T cell response in the subject includes selectively enhancing proliferation of T cell expressing the first antigen binding domain and the second antigen binding domain in vivo.

The methods for enhancing T cell response in a subject include administering to the subject T cells comprising a CAR or a bispecific CAR including two different antigen binding domains and T cells comprising a first CAR and a second CAR, wherein the first CAR and the second CAR, each includes a different antigen binding domain.

In embodiments, methods for enhancing T cell response in a subject described herein include administering to the subject T cells including a CAR molecule and a TCR molecule. The CAR molecule targets or binds a surface marker of a white blood cell, and the TCR molecule binds a marker or an antigen of the tumor that is expressed on the surface or inside the tumor cell.

In embodiments, the methods for enhancing T cell response in a subject in need thereof include administering to the subject, a mixed population of modified cells or a composition comprising a mixed population of modified cells. Examples of a mixed population of modified T cells include the following: (1) T cells containing a CAR binding an antigen of a WBC and T cells containing a CAR or TCR binding a tumor antigen; (2) the T cells of (1) and further T cells containing both (i) the CAR or TCR binding a tumor antigen, and (ii) a CAR binding an antigen of a WBC (both (i) and (ii) are in a single modified T cell); (3) T cells containing both (i) a CAR or TCR binding a tumor antigen, and (ii) a CAR binding an antigen of a WBC (both (i) and (ii) are in a single modified T cell); (4) T cells containing a CAR or TCR binding a tumor antigen and T cells containing both (i) a CAR or TCR binding a solid tumor antigen and (ii) a CAR binding an antigen of a WBC; or (5) T cells containing a CAR binding an antigen of a WBC and T cells containing both (i) a CAR or TCR binding a solid tumor antigen and (ii) the CAR binding the antigen of a WBC (both (i) and (ii) are in a single modified T cell). In embodiments, the subject is diagnosed with a solid tumor. In embodiments, the tumor antigen is a solid tumor antigen, for example tMUC1. In embodiments, the WBC is a B cell, and the antigen is a B cell antigen. In embodiments, the B cell antigen is CD19. In embodiments, the tumor antigen is tMUC1 and the antigen of a WBC is CD19.

The present disclosure describes methods of expanding and/or maintaining cells expressing an antigen binding domain in vivo. The method includes administering an effective amount of a mixed population of modified cells or a composition including a mixed population of modified cells described herein to a subject These methods described herein are useful for expanding T cells, NK cells, macrophages and/or dendritic cells.

The mixed population of modified T cells described herein include a first CAR and/or a second CAR or TCR. In embodiments, the first CAR contains a first antigen binding domain and the second CAR or TCR contains a second antigen binding domain. For example, the first CAR and the second CAR or TCR include an extracellular antigen binding domain, a transmembrane domain, and a cytoplasmic domain. The cytoplasmic domain of the first CAR and second CAR include a co-stimulatory domain and a CD3 zeta domain for transmitting signals for activation of cellular responses. In embodiments, the first CAR and second CAR or TCR are expressed on different modified T cells. In embodiments, the first CAR and second CAR or TCR are expressed on the same modified T cell.

In embodiments, in the mixed population of modified T cells described herein, the cytoplasmic domain of the first CAR, which contains an antigen binding domain for expanding and/or maintaining modified T cells, includes one or more co-stimulatory domains in the absence of a CD3 zeta domain such that activation or stimulation of the first CAR expands WBCs, such as lymphocytes, without introducing and/or activating the killing function of the modified T cells targeting the WBCs. In embodiments, the lymphocytes are T cells. In embodiments, when the cytoplasmic domain of the first CAR includes one or more co-stimulatory domains in the absence of a CD3 zeta domain, the second CAR includes a CD3 zeta domain.

In embodiments, the first and second antigen binding domains are on the same CAR (the first CAR), for example, a bispecific CAR with an extracellular antigen binding domain, a transmembrane domain, and a cytoplasmic domain. The extracellular antigen binding domain includes at least two scFvs and at least one of the scFvs function as a first antigen binding domain for binding a cell surface molecule of a WBC. In embodiments, the bispecific CAR is expressed on a modified T cell.

In embodiments, the antigen different from the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, CD13, B7-H3, CAIX, CD123, CD133, CD171, CD171/L1-CAM, CEA, Claudin 18.2, cMet, CS1, CSPG4, Dectin1, EGFR, EGFR vIII, EphA2, ERBB receptors, ErbB T4, ERBB2, FAP, Folate receptor 1, FITC, Folate receptor 1, FSH, GD2, GPC3, HA-1 H/HLA-A2, HER2, IL-11Ra, IL13 receptor a2, IL13R, IL13Rα2 (zetakine), Kappa, Leukemia, LewisY, Mesothelin, MUC1, NKG2D, NY-ESO-1, PSMA, ROR-1, TRAIL-receptor1, or VEGFR2.

In embodiments, the MUC1 is a tumor-exclusive epitope of a human MUC1, and the first CAR and the second CAR or the TCR are expressed as separate polypeptides. In embodiments, the MUC1 is a tumor form of human MUC1 (tMUC1). More information about tMUC1 can be found at PCT Patent Application NO: PCT/US2020/013099, which is incorporate herein by its reference.

In embodiments, the first CAR comprises the first antigen binding domain, a transmembrane domain, a co-stimulatory domain, and a CD3 zeta domain, and/or the second CAR comprises the second antigen binding domain, a transmembrane domain, a co-stimulatory domain, and a CD3 zeta domain.

In embodiments, the antigen binding domain is a Fab or a scFv. In embodiments, the first CAR comprises the amino acid sequence of one of SEQ ID NO: 5, 6, and 49-54; and the second CAR comprises the amino acid sequence of one of SEQ ID NOs: 5-17, 29, 32, 34, 67, and 68, or the amino acid sequence encoded by the nucleic acid sequence of one of SEQ ID NOs: 37, 41, 59, 63, and 64. In embodiments, a nucleic acid sequence encoding the first CAR comprises the nucleic acid sequence of SEQ ID NO: 55 or 56, and a nucleic acid sequence encoding the second CAR comprises the nucleic acid sequence of SEQ ID NO: 57. In embodiments, the nucleic acid comprises one of the nucleic acid sequence of SEQ ID NO: 58- 65. In embodiments, the first CAR and the second CAR are expressed as separate polypeptides.

In embodiments, the first antigen binding domain is on a CAR and the second antigen binding domain is on a T Cell Receptor (TCR). In embodiments, the TCR is a modified TCR. In embodiments, the TCR is derived from spontaneously occurring tumor-specific T cells in patients. In embodiments, the TCR binds a tumor antigen. In embodiments, the tumor antigen comprises CEA, gp100, tMUC1, MART-1, p53, MAGE-A3, or NY-ESO-1.

As used herein, "a thyroid antigen" refers to an antigen expressed on or by a thyroid cell. Examples of thyroid cells include follicular cells and parafollicular cells. A human TSHR is a receptor for thyroid-stimulating hormone (TSH) which is present on the thyroid membrane (SEQ ID NO: 20). When TSH secreted from the pituitary gland binds to TSHR on the thyroid follicle cell membrane, the thyroid gland secretes T3 and T4 having metabolic functions. TSHR is a seven-transmembrane receptor having a molecular weight of about 95,000 to 100,000 Daltons. It was reported that the human thyrotropin receptor (TSHR) includes three domains: a leucine-rich domain (LRD; amino acids 36-281), a cleavage domain (CD; amino acids 282-409), and a transmembrane domain (TMD; amino acids 410-699). Human thyrotropin (hTSH) a chains were found to bind many amino acids on the LRD surface and CD surface. As used herein, "TSHR" refers to human thyroid stimulating hormone receptor. The term should be construed to include not only human thyroid stimulating hormone receptor, but variants, homologs, fragments and portions thereof to the extent that such variants, homologs, fragments and portions thereof retain the ability of human thyroid stimulating hormone receptor to bind to antibodies or ligands of human thyroid stimulating hormone receptor as disclosed herein.

In embodiments, the antigen is a stomach or colon antigen. For example, the colon antigen is Guanylate cyclase 2C (GUCY2C) having SEQ ID NO: 23. As used herein, "a colon antigen" refers to an antigen expressed on or by a colon cell. Examples of colon cells include goblet cells and enterocytes. Guanylyl cyclase 2C (GUCY2C) is principally expressed in intestinal epithelial cells. GUCY2C is the receptor for diarrheagenic bacterial enterotoxins (STs) and the gut paracrine hormones, guanylin, and uroguanylin. These ligands regulate water and electrolyte transport in the intestinal and renal epithelia and are ultimately responsible for acute secretory diarrhea. As used herein, "GUCY2C" refers to human Guanylyl cyclase 2C. The term should be construed to include not only human Guanylyl cyclase 2C, but also variants, homologs, fragments and portions thereof to the extent that such variants, homologs, fragments and portions thereof retain the ability of Guanylyl cyclase 2C to bind antibodies or ligands of human Guanylyl cyclase 2C as disclosed herein. In embodiments, the amino acid sequence of at least a portion of GUCY2C comprises SEQ ID NO: 23. Claudin18.2 (CLDN 18.2) is a stomach-specific isoform of Claudin-18 and is highly expressed in gastric and pancreatic adenocarcinoma.

In embodiments, a T cell clone that expresses a TCR with high affinity for the target antigen may be isolated. Tumor-infiltrating lymphocytes (TILs) or peripheral blood mononuclear cells (PBMCs) can be cultured in the presence of antigen-presenting cells (APCs) pulsed with a peptide representing an epitope known to elicit a dominant T cell response when presented in the context of a defined HLA allele. High-affinity clones may then be selected on the basis of MHC-peptide tetramer staining and/or the ability to recognize and lyse target cells pulsed with low titrated concentrations of cognate peptide antigen. After the clone has been selected, the TCRα and TCRβ chains or TCRγ and TCRδ chains are identified and isolated by molecular cloning. For example, for TCRα and TCRβ chains, the TCRα and TCRβ gene sequences are then used to generate an expression construct that ideally promotes stable, high-level expression of both TCR chains in human T cells. The transduction vehicle, for example, a gammaretrovirus or lentivirus, can then be generated and tested for functionality (antigen specificity and functional avidity) and used to produce a clinical lot of the vector. An aliquot of the final product can then be used to transduce the target T cell population (generally purified from patient PBMCs), which is expanded before infusion into the patient.

Various methods may be implemented to obtain genes encoding tumor-reactive TCR. More information is provided in Kershaw et al., Clin Transl Immunology. 2014 May; 3(5): e16. In embodiments, specific TCR can be derived from spontaneously occurring tumor-specific T cells in patients. Antigens included in this category include the melanocyte differentiation antigens MART-1 and gp100, as well as the MAGE antigens and NY-ESO-1, with expression in a broader range of cancers. TCRs specific for viral-associated malignancies can also be isolated, as long as viral proteins are expressed by transformed cells. Malignancies in this category include liver and cervical cancer, associated with hepatitis and papilloma viruses, and Epstein-Barr virus-associated malignancies. In embodiments, target antigens of the TCR may include CEA (e.g., for colorectal cancer), gp100, MART-1, p53 (e.g., for Melanoma), MAGE-A3 (e.g., Melanoma, esophageal and synovial sarcoma), NY-ESO-1 (e.g., for Melanoma and sarcoma as well as Multiple myelomas).

In embodiments, a binding domain of the first CAR binds CD19, and a binding domain of the second CAR binds tumor associated MUC1 (tMUC1). In embodiments, the binding domain of the second CAR comprises: (i) a heavy chain complementary determining region 1 comprising the amino acid sequence of SEQ ID NOs: 72 or 81, a heavy chain complementary determining region 2 comprising the amino acid sequence of SEQ ID NOs: 73 or 82, and a heavy chain complementary determining region 3 comprising the amino acid sequence of SEQ ID NOs: 74 or 83; and (ii) a light chain complementary determining region 1 comprising the amino acid sequence of SEQ ID NOs: 69 or 78, a light chain complementary determining region 2 comprising the amino acid sequence of TRP-ALA-SER (WAS) or SEQ ID NO: 79, and a light chain complementary determining region 3 comprising the amino acid sequence of SEQ ID NOs: 71 or 80.

In embodiments, the binding domain of the second CAR comprises: (i) a heavy chain complementary determining region 1 comprising the amino acid sequence of SEQ ID NO: 72, a heavy chain complementary determining region 2 comprising the amino acid sequence of SEQ ID NO: 73, and a heavy chain complementary determining region 3 comprising the amino acid sequence of SEQ ID NO: 74; and (ii) a light chain complementary determining region 1 comprising the amino acid sequence of SEQ ID NO: 69, a light chain complementary determining region 2 comprising the amino acid sequence of TRP-ALA-SER (WAS), and a light chain complementary determining region 3 comprising the amino acid sequence of SEQ ID NO: 71.

In embodiments, the binding domain of the second CAR comprises: (i) a heavy chain complementary determining region 1 comprising the amino acid sequence of SEQ ID NO: 81, a heavy chain complementary determining region 2 comprising the amino acid sequence of SEQ ID NO: 82, and a heavy chain complementary determining region 3 comprising the amino acid sequence of SEQ ID NO: 83; and (ii) a light chain complementary determining region 1 comprising the amino acid sequence of SEQ ID NO: 78, a light chain complementary determining region 2 comprising the amino acid sequence of SEQ ID NO: 79, and a light chain complementary determining region 3 comprising the amino acid sequence of SEQ ID NO: 80. In embodiments, the binding domain of the first CAR comprises the amino acid sequence of SEQ ID NOs: 5 or 6. In embodiments, the binding domain of the second CAR comprises one of the amino acid sequences of SEQ ID NOs: 66-68 and 75-77.

In embodiments, the first CAR comprises the first antigen binding domain, a transmembrane domain, a co-stimulatory domain, and a CD3 zeta domain and/or the second CAR comprises the second antigen binding domain, a transmembrane domain, a co-stimulatory domain, and a CD3 zeta domain.

In embodiments, the first CAR and the second CAR are expressed as separate polypeptides.

In embodiments, the cytoplasmic domain or the transmembrane domain of the second CAR is modified such that the second CAR is capable of activating the modified T cell via cells expressing CD19 without damaging the cells expressing CD19.

Embodiments described herein relate to a bispecific chimeric antigen receptor, comprising: a first antigen binding domain, a second antigen binding domain, a cytoplasmic domain, and transmembrane domain, wherein the first antigen binding domain recognizes a first antigen, and the second antigen binding domain recognizes a second antigen, the first antigen is different from the second antigen.

In embodiments, the first antigen and the second antigen do not express on the same cell. In embodiments, the first antigen is an antigen of a blood component, and the second antigen is an antigen of a solid tumor.

Blood cells refer to red blood cells (RBCs), white blood cells (WBCs), platelets, or other blood cells. For example, RBCs are blood cells of delivering oxygen ($O_2$) to the body tissues via the blood flow through the circulatory system. Platelets are cells that are involved in hemostasis, leading to the formation of blood clots. WBCs are cells of the immune system involved in defending the body against both infectious disease and foreign materials. There are a number of different types and sub-types of WBCs and each has a different role to play. For example, granulocytes, monocytes, and lymphocytes are 3 major types of white blood cell. There are three different forms of granulocytes: Neutrophils, Eosinophils, Basophils.

A cell surface molecule of a WBC refers to a molecule expressed on the surface of the WBC. For example, the cell surface molecule of a lymphocyte may include CD19, CD22, CD20, BCMA, CD5, CD7, CD2, CD16, CD56, and CD30. The cell surface molecule of a B cell may include CD19, CD20, CD22, BCMA. The cell surface molecule of a monocyte may include CD14, CD68, CD11b, CD18, CD169, and CD1c. The cell surface molecule of granulocyte may include CD33, CD38, CD138, and CD13.

In embodiments, the first antigen is CD19, and the second antigen is a tumor associated MUC1 (tMUC1). In embodiments, the first antigen binding domain comprises one of the amino acid sequences of SEQ ID NOs: 5 and 6. In embodiments, the second antigen binding domain comprises one of the amino acid sequences of SEQ ID NOs: 66-68 and 75-77.

In embodiments, the present disclosure describes a method of enhancing T cell response in a subject in need thereof or treating a tumor of a subject, the method comprising: administering an effective amount of a mixed population of modified T cells or a composition of a mixed population of modified T cells, described herein, to the subject to provide a T cell response such that the CAR T cell is expanded in the blood of the subject via cells expressing CD19. In embodiments, the method may further comprise infusing B cells into the subject to continue to activate and/or expand the CAR T cells. For example, the B cells of the subject or genetically modified B cells from healthy donor may be obtained and stored before CAR T cell infusion. In embodiments, the method may further comprise administering a cell expressing CD19 or a polypeptide comprising at least an extracellular domain of CD19 or the antigen that the CAR T cells recognize. For example, the cell expressing CD19 may include cell lines such as K562 and NK92 that are transduced with nucleic acid sequences encoding CD19. In embodiments, the method may further comprise identifying CAR T cells expressing both first and second CAR, as well as administering the identifier CAR T cells to the subject. For example, MUC1 may be associated as a sorting marker such that CAR T cells expressing MUC1 may be identified timely.

In embodiments, the tumor associated MUC1 (tMUC1) is expressed on tumor cells, but not on corresponding non-malignant cells. In embodiments, a scFv against the tumor associated MUC1 directly interacts with an o-glycosylated GSTA motif (SEQ ID NO: 84).

In embodiments, the present disclosure describes a method of in vivo cell expansion and maintenance. In embodiments, the method may include administering an effective amount of a mixed population of modified T cells described herein to the subject in need thereof to provide a T cell response; and administering an effective amount of presenting cells (e.g., T cells) expressing a soluble agent that an extracellular domain of the CAR recognizes. In embodiments, the method may be implemented to enhance T cell response in a subject in need thereof. The method may include administering an effective amount of a mixed population of modified T cells comprising a CAR to the subject to provide a T cell response and administering an effective amount of presenting cells expressing a soluble agent that an extracellular domain of the CAR recognizes to enhance the T cell response in the subject. In embodiments, the presenting cells are T cells, dendritic cells, and/or antigen presenting cells. In embodiments, the enhancing T cell response in the subject may include selectively enhancing proliferation of T cell comprising the CAR. In embodiments, the method may be used to enhance treatment of a condition of a subject using modified T cells. The method may include administering a population of cells that express an agent or administering an agent that is formulated as a vaccine. In these instances, the modified T cells include a nucleic acid that encodes a CAR, and an extracellular domain of the CAR recognize the agent. In embodiments, the method may be implemented to enhance proliferation of the modified T cells in a subject having a disease. The method may include preparing the modified T cells comprising a CAR; administering an effective amount of the modified T cells to the subject; introducing, into cells, a nucleic acid encoding an agent that an extracellular domain of the CAR recognizes; and administering an effective amount of the cells (introduced with the nucleic acid encoding the agent) to the subject. In embodiments, the T cell expansion may be measured based on an increase in copy number of CAR molecules in genomic DNA of the T cells. In embodiments, the T cell expansion may be measured based on flow cytometry analysis on molecules expressed on the T cells.

A presenting agent comprises an article/particle (e.g., breads) or a presenting cell. In embodiments, the presenting agent comprises a non-cell blood component with which the antigen is attached. In embodiments, the presenting agent comprises a bead attached with an antigen. A presenting cell refers to a cell that comprises an antigen and is capable of presenting the antigen to another cell (e.g., T cell). For example, the presenting cell may be introduced a polynucleotide encoding the antigen or squeezed with a particle associated with the antigen. In embodiments, the presenting comprises a PBMC derived from a subject having cancer or a healthy donor. In embodiments, the presenting comprises a white blood cell. In embodiments, the presenting comprises a blood cell. In embodiments, the presenting cell comprises an antigen-presenting cell (APC) or accessory cell is a cell that displays antigen complexed with major histocompatibility complexes (MHCs) on their surfaces; this process is known as antigen presentation. T cells may recognize these complexes using their T cell receptors (TCRs). APCs process antigens and present them to T-cells. In embodiments, the presenting cell comprises a B cell. In embodiments, the presenting cell comprises a T cell. In embodiments, the presenting cell comprises a DC. In embodiments, the presenting cell comprises a macrophage.

Embodiments described herein relate to mixed population of modified T cells comprising a first CAR and a second CAR or TCR in separate T cells and/or in the same T cells, wherein an antigen binding domain of the first CAR binds an antigen such as CD19, CD33, CD14, and BCMA, and an antigen binding domain of the second CAR binds a tumor associated MUC. In embodiments, the tumor associated MUC is MUC1 (for example tMUC1) or MUC2. Embodiments described herein relate to a composition comprising a mixed population of the modified T cells and to a method of enhancing T cell response in a subject in need thereof or treating a tumor of a subject, the method comprising: administering an effective amount of the mixed population of modified T cells.

In embodiments, the first CAR comprises the amino acid sequence of SEQ ID NO: 198, and the second CAR comprises the amino acid sequence of SEQ ID NO: 193. In embodiments, the first CAR comprises the amino acid sequence of SEQ ID NOs: 194, 198, 207, or 210, and the second CAR comprises the amino acid sequence of SEQ ID NOs: 193 or 196. In embodiments, the antigen binding domain of the second CAR comprises the amino acid sequence of SEQ ID NO: 66. In embodiments, the antigen binding domain of the second CAR comprises the amino acid sequence of SEQ ID NOs: 5 or 6. In embodiments, the a modified T cell described herein comprises a nucleic acid sequences of SEQ ID NOs: 192, 195, 197, 199, 206, 208, 209, or 211. In embodiments, each of the first CAR and the second CAR comprises an antigen binding domain, a transmembrane domain, and a cytoplasmic domain.

In embodiments, the cytoplasmic domain of the CAR molecules described herein comprise a co-stimulatory domain and a CD3 zeta domain. In embodiments, the CAR molecules described herein may include a co-stimulatory domain without a corresponding component of CD3 zeta domain. In embodiments, the CAR molecules described herein may include a CD3 zeta domain without a co-stimulatory domain.

In embodiments, the modified cell comprises a dominant negative variant of a receptor of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIRD, natural killer cell receptor 2B4 (2B4), or CD 160. In embodiments, the modified cell further comprises a nucleic acid sequence encoding a suicide gene, and/or the suicide gene comprises a HSV-TK suicide gene system. In embodiments, the isolated T cell comprises a reduced amount of TCR, as compared to the corresponding wide-type T cell.

Dominant negative mutations have an altered gene product that acts antagonistically to the wild-type allele. These mutations usually result in an altered molecular function (often inactive) and are characterized by a dominant or semi-dominant phenotype. In embodiments, the modified cells described herein comprise the dominant negative (DN) form of the PD-1 receptor. In embodiments, the expression of the DN PD-1 receptor in the modified cells described herein is regulated by an inducible gene expression system. In embodiments, the inducible gene expression system is a lac system, a tetracycline system, or a galactose system.

The present disclosure describes pharmaceutical compositions. The pharmaceutical compositions include one or more of the following: CAR molecules, TCR molecules, modified CAR T cells, modified cells comprising CAR or TCR, mix population of modified cells, nucleic acids, and vectors described herein. Pharmaceutical compositions are administered in a manner appropriate to the disease to be treated (or prevented). The quantity and frequency of administration will be determined by such factors as the condition of the patient, and the type and severity of the patient's disease, although appropriate dosages may be determined by clinical trials.

The term "pharmaceutically acceptable" means approved by a regulatory agency of the U.S. Federal or a state government or the EMA (European Medicines Agency) or listed in the U.S. Pharmacopeia Pharmacopeia (United States Pharmacopeia-33/National Formulary-28 Reissue, published by the United States Pharmacopeia Convention, Inc., Rockville Md., publication date: April 2010) or other generally recognized pharmacopeia for use in animals, and more particularly in humans.

The term "carrier" refers to a diluent, adjuvant {e.g., Freund's adjuvant (complete and incomplete)), excipient, or vehicle with which the therapeutic is administered. Pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions.

The present disclosure also describes a pharmaceutical composition comprising the first and the second population of cells, described herein. The pharmaceutical composition described herein, comprising a first population of cells comprising a first antigen binding molecule and a second population of cells comprising a second antigen binding domain, are suitable for cancer therapy. For example, the binding of first antigen binding molecule with an antigen enhances capabilities (e.g., expansion) of the cells suitable for cancer therapy.

The present disclosure also describes a method for enhancing cancer therapy using the cells described herein that are suitable for cancer therapy. The method comprises administering an effective amount of a first composition to the subject having a form of cancer expressing a tumor antigen, the first composition comprising a first population of cells (e.g., T cells) comprising a first antigen binding molecule (e.g., CAR) binding a first antigen; and administering an effective amount of a second composition to the subject, the second composition comprising a population of the cells comprising a second antigen binding molecule. Administration of the first and second compositions can be performed simultaneously or separately, for example sequentially. More information about the cells suitable for cancer therapy can be found at Eyileten et al., Immune Cells in Cancer Therapy and Drug Delivery, Mediators Inflamm. 2016; 2016: 5230219, which is incorporated herein for reference.

In embodiments, the method comprises administering an effective amount of a population of CAR T cells binding a WBC antigen; and administering an effective amount of a population of CAR T cells binding a solid tumor antigen. In embodiments, the method comprises administering an effective amount of a population of CAR T cells binding a WBC antigen; and administering an effective amount of a population of T cells binding a solid tumor antigen (T cells used in TCR and TIL therapies). In embodiments, the method comprises administering an effective amount of a population of CAR T cells binding a WBC antigen; and administering an effective amount of a population of NK cells or NK cells expressing CAR binding a solid tumor antigen. In embodiments, the method comprises administering an effective amount of a population of CAR T cells binding a WBC antigen; and administering an effective amount of a population of NK cells or NK cells expressing CAR binding a solid tumor antigen. In embodiments, the method comprises administering an effective amount of a population of CAR T cells binding a WBC antigen; and administering an effective amount of a population of DCs or DCs expressing CAR binding a solid tumor antigen. In embodiments, the method comprises administering an effective amount of a population of CAR T cells binding a WBC antigen; and administering an effective amount of a population of macrophages or macrophages expressing CAR binding a solid tumor antigen. In embodiments, the method comprises administering an effective amount of a population of CAR T cells binding a WBC antigen; and administering an effective amount of a population of neutrophils or neutrophils expressing CAR binding a solid tumor antigen. In embodiments, the method comprises administering an effective amount of a population of CAR T cells binding a WBC antigen; and administering an effective amount of a population of lymphocytes binding or targeting a solid tumor antigen. In embodiments, the solid tumor antigen can be located on the cell surface (e.g., TSHR), on the extracellular matrix of tumor microenvironment (e.g., $\alpha v\beta 5$ integrin), and/or inside of tumor cells (e.g., gp100).

When "an immunologically effective amount", "an anti-tumor effective amount", "a tumor-inhibiting effective amount", or "a therapeutically effective amount" is indicated, the precise amount of the compositions of the present disclosure to be administered can be determined by a physician with consideration of individual differences in age, weight, tumor size, extent of infection or metastasis, and condition of the patient (subject). It can be stated that a pharmaceutical composition comprising the modified cells described herein may be administered at a dosage of $10^4$ to $10^9$ cells/kg body weight, preferably $10^9$ to $10^6$ cells/kg body weight, including all integer values within those ranges. Modified cell compositions may also be administered multiple times at these dosages. The cells can be administered by using infusion techniques that are commonly known in immunotherapy (see, e.g., Rosenberg et al., New Eng. J. of Med. 319:1676, 1988). The optimal dosage and treatment regime for a particular patient can readily be determined by one skilled in the art of medicine by monitoring the patient for signs of disease and adjusting the treatment accordingly. In embodiments, it may be desired to administer activated T cells to a subject and then subsequently redraw the blood (or have apheresis performed), collect the activated and expanded T cells, and reinfuse the patient with these activated and expanded T cells. This process can be carried out multiple times every few weeks. In embodiments, T cells can be activated from blood draws of from 10 cc to 400 cc. In embodiments, T cells are activated from blood draws of 20 cc, 30 cc, 40 cc, 50 cc, 60 cc, 70 cc, 80 cc, 90 cc, or 100 cc. Not to be bound by theory, using this multiple blood draw/multiple reinfusion protocols, may select out certain populations of T cells.

In embodiments, a mixed population of therapeutically effective amount of modified cells can be administered to the subject in need thereof sequentially or simultaneously. As an example, for a mixed population of two different modified cells, a therapeutically effective amount of the modified cells containing the antigen binding domain for expanding and/or maintaining the modified cells can be administered before, after, or at the same time a therapeutically effective amount of the modified cells containing the antigen binding domain for killing a target cell. As another example of a mixed population of two different modified cells, a therapeutically effective amount of the modified cells containing the antigen binding domain for killing a target cell can be administered before, after, or at the same time a therapeutically effective amount of the modified cells containing both the antigen binding domains of expanding and/or maintaining the modified cells and of killing a target cell (in a single modified cell). As an example, for a mixed population of three different modified cells including (1) modified cells containing an antigen binding domain for expanding and/or maintaining the modified cells, (2) modified cells containing an antigen binding domain for killing a target cell, and (3) modified cells containing both the antigen binding domains of expanding and/or maintaining the modified cells and of killing a target cell (in a single modified cell), a therapeutically effective amount of (1), (2), and (3) can be administered sequentially in any order (1, 2, 3; 2, 3, 1; 3, 1, 2; 1, 3, 2; 2, 1, 3; or 3, 2, 1) or simultaneously (1+2+3 at the same time). Moreover, two of the three modified cells can be combined and administered together with the third one being administered before or after the combination. For example, the combination of (1) and (2) can be administered before or after (3); or the combination of (1) and (3) can be administered before or after (2); or the combination of (2) and (3) can be administered before or after (1).

The administration of the pharmaceutical compositions described herein may be carried out in any convenient manner, including by aerosol inhalation, injection, ingestion, transfusion, implantation, or transplantation. The compositions described herein may be administered to a patient subcutaneously, intradermally, intratumorally, intranodally, intramedullary, intramuscularly, by intravenous (i. v.) injection, or intraperitoneally. In embodiments, the modified cell compositions described herein are administered to subjects by intradermal or subcutaneous injection. In embodiments, the T cell compositions of the present disclosure are administered by i.v. injection. The compositions of modified cells may be injected directly into a tumor, lymph node, or site of infection. In embodiments, cells activated and expanded using the methods described herein, or other methods known in the art where T cells are expanded to therapeutic levels, are administered to patients in conjunction with (e.g., before, simultaneously or following) any number of relevant treatment modalities, for example as a combination therapy, including but not limited to treatment with agents for antiviral therapy, cidofovir and interleukin-2, Cytarabine (also known as ARA-C); or natalizumab treatment for MS patients; or efalizumab treatment for psoriasis patients or other treatments for PML patients. In further embodiments, the T cells described herein can be used in combination with chemotherapy, radiation, immunosuppressive agents, such as cyclosporin, azathioprine, methotrexate, mycophenolate, and FK506, antibodies, or other immunoablative agents such as CAM PATH, anti-CD3 antibodies or other antibody therapies, cytoxin, fludaribine, cyclosporin, FK506, rapamycin, mycophenolic acid, steroids, FR901228, cytokines, and irradiation. These drugs inhibit either the calcium dependent phosphatase calcineurin (cyclosporine and FK506) or inhibit the p70S6 kinase that is important for growth factor induced signaling (rapamycin). (Liu et al., Cell 66:807-815, 1991; Henderson et al., Immun 73:316-321, 1991; Bierer et al., Curr. Opin. Immun 5:763-773, 1993; Isoniemi (supra)). In embodiments, the cell compositions described herein are administered to a subject in conjunction with (e.g., before, simultaneously or following) bone marrow transplantation, T cell ablative therapy using either chemotherapy agents such as, fludarabine, external-beam radiation therapy (XRT), cyclophosphamide, or antibodies such as OKT3 or CAMPATH. In embodiments, the cell compositions described herein are administered following B-cell ablative therapy. For example, agents that react with CD20, e.g., Rituxan may be administered to patients. In embodiments, subjects may undergo standard treatment with high dose chemotherapy followed by peripheral blood stem cell transplantation. In embodiments, following the transplant, subjects receive an infusion of the expanded immune cells of the present disclosure. In embodiments, expanded cells are administered before or following surgery. The dosage of the above treatments to be administered to a subject in need thereof will vary with the precise nature of the condition being treated and the recipient of the treatment. The scaling of dosages for human administration can be performed according to art-accepted practices by a physician depending on various factors. Additional information on the methods of cancer treatment using modified cells is provided in U.S. Pat. No. 8,906,682, incorporated by reference in its entirety.

Embodiments described herein relate to an in vitro method for preparing modified cells. The method may include obtaining a sample of cells from a subject. For example, the sample may include T cells or T cell progenitors. The method may further include transfecting the sample of cells with a DNA encoding at least a CAR and culturing the sample of cells ex vivo in a medium that selectively enhances proliferation of CAR-expressing T cells. The sample of cells can be a mixed population of modified cells described herein.

In embodiments, the sample is a cryopreserved sample. In embodiments, the sample of cells is from umbilical cord blood or a peripheral blood sample from the subject. In embodiments, the sample of cells is obtained by apheresis or venipuncture. In embodiments, the sample of cells is a subpopulation of T cells.

In embodiments, the modified cells include a nucleic acid sequence encoding hTERT or a nucleic acid encoding SV40LT, or a combination thereof. In embodiments, the modified cells include a nucleic acid sequence encoding hTERT and a nucleic acid encoding SV40LT. In embodiments, the expression of hTERT is regulated by an inducible expression system. In embodiments, the expression of SV40LT gene is regulated by an inducible expression system. In embodiments, the inducible expression system is rTTA-TRE, which increases or activates the expression of SV40LT gene or hTERT gene, or a combination thereof. In embodiments, the modified cells include a nucleic acid sequence encoding a suicide gene. In embodiments, the suicide gene includes an HSV-TK suicide gene system. In these instances, the modified cell can be induced to undergo apoptosis.

The present disclosure describes methods of treating cancer in a subject, the methods comprising administering a mixed population of modified cells described herein to the subject, wherein the cancer is selected from the group consisting of a lung carcinoma, pancreatic cancer, liver cancer, bone cancer, breast cancer, colorectal cancer, leukemia, ovarian cancer, lymphoma, and brain cancer.

For example, T cell response in a subject refers to cell-mediated immunity associated with helper, killer, regulatory, and other types T cells. For example, T cell response may include activities such as assistance to other white blood cells in immunologic processes and identifying and destroying virus-infected cells and tumor cells. T cell response in the subject may be measured via various indicators such as a number of virus-infected cells and/or tumor cells that the T cells kill, an amount of cytokines that the T cells release in co-culturing with virus-infected cells and/or tumor cells, a level of proliferation of the T cells in the subject, a phenotype change of the T cells (e.g., changes to memory T cells), and the longevity or the length of the lifetime of the T cells in the subject.

T cell response also includes the release of cytokines. Although cytokine release is often associated with systemic inflammation and complication of disease, the release of cytokines appears to be also associated with the efficacy of a CAR T cell therapy. The release of cytokines may correlate with expansion and progressive immune activation of adoptively transferred cells, such as in CAR T cell therapy. The present disclosure describes the release of effector cytokines, such as IFN-γ, and pro- and anti-inflammatory cytokines, such as IL-6, in response to mixed population of modified T cells described herein, especially in response to the presence of a first CAR including an antigen binding domain for expanding cells and a second CAR or TCR including an antigen binding domain for killing a target cell. In embodiments, the present disclosure describes the release of IL-6 and IFN-γ in a subject introduced with the first CAR and second CAR or TCR described herein. In embodiments, the subject is in need of cancer treatment, and the cancer treatment is pancreatic cancer treatment. In embodiments, the present disclosure describes determining the efficacy or monitoring the efficacy of a CAR T cell therapy by measuring the level of cytokine release. In embodiments, the release of cytokines (e.g., IL-6 and/or IFN-γ) in the subject in response to CAR T cell therapy using mixed population of modified T cells described herein is more than that using T cells comprising the second CAR without the first CAR.

The present disclosure describes a composition comprising a mixed population of modified cells described herein. In embodiments, there is a first population of modified cells comprising a first CAR binding a first antigen, and a second population of modified cells comprising a second CAR or TCR binding a second antigen that is different from the first antigen. The first antigen can be an antigen of a WBC, such as a B cell, while the second antigen is a tumor antigen. The present disclosure describes a method of enhancing capabilities (e.g., expansion) and maintenance of the second population of modified cells for killing tumor cells. The method includes administering an effective amount of the composition comprising a mixed population of modified cells to a subject having a form of cancer associated with the tumor antigen which the second CAR recognizes and binds. Embodiments also include a method of enhancing T cell response in a subject in need thereof or treating a subject having cancer. The method includes administering an effective amount of the composition described herein to the subject having a form of cancer associated with the tumor antigen which the second CAR recognizes and binds. Further the embodiments include a method of enhancing capabilities (e.g., expansion) and/or maintenance of modified cells in a subject, the method comprising: contacting T cells with a first vector comprising a first nucleic acid sequence encoding the first CAR and a second vector comprising a second nucleic acid sequence encoding the second CAR to obtain the composition described herein of a mixed population of modified cells; and administering an effective amount of the composition to the subject having a form of cancer associated with the tumor antigen which the second CAR recognizes and binds. Additional embodiments include a method of enhancing T cell response in a subject in need thereof or treating a subject having cancer, the method comprising: contacting T cells with a first vector comprising a first nucleic acid sequence encoding the first CAR and a second vector comprising a second nucleic acid sequence encoding the second CAR to obtain the composition described herein of a mixed population of modified cells; and administering an effective amount of the composition to the subject having a form of cancer associated with the tumor antigen, which the second CAR recognizes and binds. Embodiments include a method of enhancing capabilities (e.g., expansion) and maintenance of the modified cells in a subject, the method comprising: administering an effective amount of the composition described herein of a mixed population of modified cells.

In embodiments, the composition comprises at least the first population and second population of modified cells. The first population of modified cells comprises a polynucleotide encoding the first CAR (e.g., CD19, CD22, and BCMA CARs) and a polynucleotide encoding one or more cytokines (e.g., IL-6, IL12, and IFNγ). The second population of modified cells comprises a polynucleotide encoding the second CAR binding a solid tumor antigen. For example, the composition comprises the first population, the second, the third, and the fourth populations of modified cells. The first population of modified cells comprises a polynucleotide encoding CAR binding a WBC antigen and IL-6. The second population of modified cells comprises a polynucleotide encoding CAR binding a solid tumor antigen. The third population of modified cells comprises a polynucleotide encoding CAR binding a WBC antigen and IL-12. The fourth population of modified cells comprises a polynucleotide encoding CAR binding a WBC antigen and IFNγ. These WBC antigens can be the same (e.g., CD19) or different (e.g., CD19 and BCMA). The first, the third, and the fourth populations of modified cells can be mixed based on a first predetermined ratio to obtain a group of modified cells, which can be then mixed based on a second predetermined ratio with the second population of modified cells to obtain a composition comprising a mixed population of modified cells. The predetermined ratio is used to control the amount of expression of the one or more cytokines in the subject to achieve controllable, lasting, and efficient cytokine effects in the subject while having less cytotoxicity. In embodiments, the first predetermined ratio ratio the first, the third, and the fourth populations of modified cells is set such that there are more of modified cells comprising the polynucleotide encoding IFNγ than the modified cells comprising the polynucleotide encoding IL-12 or IL-6. For example, the first predetermined ratio is 1:1:10. In embodiments, the second predetermined ratio is determined such that there are more of the modified cells comprising the polynucleotide encoding the second CAR (e.g., the second population of modified cells) than the modified cells comprising the polynucleotide encoding the first CAR (e.g., the first, the second, and/or the third populations of modified cells). For example, the second predetermined ratio of the first population of modified cells and the second population of modified cells is less than 1:1 but more than 1:10,000. In embodiments, the second predetermined ratio is 1:1, 1:10, 1:100, 1:1000, and 1:104, as well as individual numbers within that range, for example, 1:10, 1:100, or 1:1000. In embodiments, the second predetermined ratio is between 1:10 and 1:1000. In embodiments, the second predetermined ratio is between 1:10 and 1:100. In embodiments, the second predetermined ratio is between 1:1 and 1:100. In embodiments, the cells (e.g., NK cells, T cells, B cells, myeloid-derived cells, etc.) are obtained from a subject or a healthy donor and divided into at least two groups. These groups of cells may be transferred with two or more vectors, respectively. These cells can be further modified if obtained from a healthy donor. In embodiments, the second population of modified cells does not express the one or more cytokines.

In embodiments, a polynucleotide encoding the first CAR is present in the modified cell in a recombinant DNA construct, in an mRNA, or in a viral vector. In embodiments, the polynucleotide is an mRNA, which is not integrated into the genome of the modified cell, such that the modified cell expresses the first CAR (e.g., CD19 CAR) for a finite period of time.

In embodiments, the mixed population of modified cells further includes a third population of modified cells expressing a third CAR and/or a fourth population of modified cells expressing a fourth CAR such that immune responses caused by the various population of modified cells can be coupled to boost CAR T treatment. In embodiments, CARs may be replaced by TCRs or a combination of CAR and TCR.

Embodiments relate to a method of enhancing CAR T therapy by implementing multiple infusion of CAR T cells timely. The method includes obtaining PBMC from a subject or a healthy donor, preparing CAR T cells using the obtained PBMC, culturing the CAR T cells, for example, for a predetermined amount of time, administering a portion of the cultured CAR T cells to the subject, observing and/or measuring the CART cells in the blood of the subject, administering a second portion of the cultured CAR T cells when the level of the CAR T cells in the blood reaches a predetermined value or when the CAR T cells home to an organ (e.g., lymph node). For example, the first infused CAR T cells can be selectively activated and expanded in the organ and cause an immune response by the subject. Thus, infusion of the second portion of CAR T cells can be coupled with the immune response to enhance the activation and/or capabilities (e.g., expansion) of the second population of CART cells, thus enhancing the CAR T therapy.

The present disclosure describes a composition including a population of modified cells including a first population of modified cells that comprises a first CAR without a second CAR, and/or a second population of modified cells that comprises a second CAR without a first CAR. The present disclosure also describes a composition including a population of modified cells comprising the first CAR and second CAR (in a single modified cell). In embodiments, the composition includes a first and a second population of modified cells and a third population of modified cells comprising one or more nucleic acid sequences encoding the first CAR and the second CAR in the same modified cell. In embodiments, the composition comprises a second population of modified cells, in the absence of a first population of genetically modified cells, and a third population of modified cells comprising one or more nucleic acid sequences encoding the first CAR and the second CAR in the same modified cells.

Embodiments relate to a method of using or the use of polynucleotide encoding the antigen binding molecule and/or therapeutic agent(s) to enhance the capabilities (e.g., expansion) of the modified cells or to enhance the T cell response in a subject. The method or use includes: providing a viral particle (e.g., AAV, lentivirus or their variants) comprising a vector genome, the vector genome comprising the polynucleotide, wherein the polynucleotide is operably linked to an expression control element conferring transcription of the polynucleotide; and administering an amount of the viral particle to the subject such that the polynucleotide is expressed in the subject. In embodiments, the AAV preparation may include AAV vector particles, empty capsids and host cell impurities, thereby providing an AAV product substantially free of AAV empty capsids. More information of the administration and preparation of the viral particle may be found at the U.S. Pat. No. 9,840,719 and Milani et al., Sci. Transl. Med. 11, eaav7325 (2019) 22 May 2019, which are incorporated herein by reference.

In embodiments, the polynucleotide may integrate into the genome of the modified cell and the progeny of the modified cell will also express the polynucleotide, resulting in a stably transfected modified cell. In embodiments, the modified cell expresses the polynucleotide encoding the CAR but the polynucleotide does not integrate into the genome of the modified cell such that the modified cell expresses the transiently transfected polynucleotide for a finite period of time (e.g., several days), after which the polynucleotide is lost through cell division or other factors. For example, the polynucleotide is present in the modified cell in a recombinant DNA construct, in an mRNA, or in a viral vector, and/or the polynucleotide is an mRNA, which is not integrated into the genome of the modified cell.

In embodiments, the first population of cells comprises the first CAR and the second CAR, and the second population of cells comprises the first CAR but does not comprise the second CAR. In embodiments, the first population of cells comprises the first CAR and the second CAR, and the second population of cells comprises the first CAR and the second CAR. In embodiments, first population of cells comprises the first CAR but does not comprise the second CAR, the second population of cells comprises the first CAR and the second CAR. In embodiments, the first population of cells comprises the first CAR but does not contain the second CAR, and the second population of cells comprise the second CAR but does comprise first CAR. In embodiments, first population of cells comprises the second CAR but does not comprise the first CAR and the second population of cells comprises the first CAR and the second CAR. In embodiments, the first population of cells comprises the first CAR but does not comprise the second CAR; the second population comprises a second CAR but does not comprise the first CAR; and a third population comprises the first CAR and the second CAR. As described herein, the first CAR includes an antigen binding domain for expanding and/or maintaining the modified cells, and the second CAR includes an antigen binding domain for killing target cells, such as tumors.

In embodiments, the antigen binding domain binds an antigen that is or that comprises a cell surface molecule of a white blood cell (WBC), a tumor antigen, or a solid tumor antigen. In embodiments, the WBCs are T cells, NK cells, or dendritic cells.

In embodiments, the WBC is a granulocyte, a monocyte, or lymphocyte. In embodiments, the WBC is a B cell. In embodiments, the cell surface molecule or antigen of the B cell is CD19, CD22, CD20, BCMA, CD5, CD7, CD2, CD16, CD56, CD30, CD14, CD68, CD11 b, CD18, CD169, CD1c, CD33, CD38, CD138, or CD13. In embodiments, the cell surface molecule or antigen of the B cell is CD19, CD20, CD22, or BCMA. In embodiments, the cell surface molecule or antigen of the B cell is CD19.

In embodiments, the tumor antigen is a solid tumor antigen. In embodiments, the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-R$\alpha$2, Mesothelin, PSMA, ROR1, VEGFR-II, GD2, FR-$\alpha$, ErbB2, EpCAM, EGFRvIII, B7-H3, or EGFR. In embodiments, the solid tumor antigen is or comprises tumor associated MUC1 (tMUC1), TSHR, GUCY2C, ACPP, CLDN18.2 (18.2), PSMA, or UPK2.

In embodiments, the CAR comprises the antigen binding domain, a transmembrane domain, a co-stimulatory domain, and a CD3 zeta domain. In embodiments, the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof. In embodiments, the second CAR includes a binding domain that binds tMUC1 and a co-stimulatory domain that includes an intracellular domain of CD28; and/or the first CAR includes a binding domain that binds CD19 and a co-stimulatory domain that includes an intracellular domain of 4-1BB.

In embodiments, the first population of cells and/or the second population of cells further comprise a dominant negative form of a checkpoint protein or of the checkpoint protein's receptor present on T cells (e.g., PD-1). In embodiments, the first population of cells comprise a vector comprising a nucleic acid encoding the first CAR and the dominant negative form of PD-1.

In embodiments, the second CAR comprises a scFv binding tMUC1, an intracellular domain of 4-1BB or CD28, CD3 zeta domain, and the second CAR comprises a scFv binding CD19, an intracellular domain of 4-1BB or CD28, CD3 zeta domain. In embodiments, the first CAR comprises a scFv, which is SEQ ID NO: 5, and the second CAR comprise a scFv, which is the SEQ ID NO: 66. Corresponding sequences are listed in Table 2.

Embodiments relate to a method comprising administering an effective amount of the second population of T cells comprising a second CAR comprising a scFv binding tMUC1 to a patient having cancer. The second CAR may further comprise an intracellular domain of 4-1BB or CD28, CD3 zeta domain. In embodiments, the method further comprises administering an effective amount of the first population of T cells comprising a first CAR comprising a scFv binding CD19 to the patient, thereby enhancing capabilities (e.g., expansion) of the second population of T cells in the patient. The CAR may further comprise an intracellular domain of 4-1BB or CD28, and CD3 zeta domain.

In embodiments, the second CAR comprises the intracellular domain of CD28, and the first CAR comprises the intracellular domain of 4-1BB. In this instance, the first population of T cells comprising CD19 may cause less adverse effect on the patient (e.g., CRS), and/or the second population of T cells comprising tMUC1 may cause enhanced T cell response (e.g., killing) as compared to those of the second CAR comprising the intracellular domain of 4-1BB and/or the first CAR comprising the intracellular domain of CD28. In embodiments, the second CAR comprises the intracellular domain of CD28 such that the second population of T cells may cause enhanced T cell response (e.g., killing) as compared to that of the second CAR comprising the intracellular domain of 4-1BB. In embodiments, the first CAR comprises the intracellular domain of 4-1BB such that the first population of T cells may cause less adverse effect on the patient (e.g., CRS) as compared to that of the first CAR comprising the intracellular domain of CD28.

In embodiments, the second population of cells comprises the scFv binding a solid tumor antigen but do not comprise the scFv binding a B cell antigen, and the first population of cells comprises the scFV binding an antigen different from the solid tumor antigen (e.g., a WBC antigen or a B cell antigen) but do not comprise the scFV binding the tumor antigen. In these instances, the T cell response of the patient induced by binding between the first population of T cells and the antigen (e.g., CD19) may cause both the first and second populations of T cells to expand. Accordingly, the patient may be administered with a mixed population of genetically engineered T cells consisting essentially of the first population of cells and the second population of cells. In embodiments, the patient may be administered with the second population of genetically engineered T cells and one or more recombinant proteins (e.g., cytokine such as IL6 and/or INF$\gamma$) or cells expressing and secretion of the one or more recombinant proteins, which may induce similar or enhanced T cell response caused by the first population of T cells. In embodiments, the patient may be administered with the second population of T cells and a hormone drug (e.g., fulvestrant), which may induce similar or enhanced T cell response caused by the first population of T cells.

In embodiments, the first population of modified cells can further comprise a third CAR comprising the scFv binding tMUC1, the intracellular domain of 4-1BB or CD28, and the CD3 zeta domain. In embodiments, the second population of cells does not comprise the scFv binding CD19. In embodiments, the first population of cells does not comprise the scFv binding tMUC1.

In embodiments, the methods described herein of enhancing cell capabilities (e.g., expansion) and/or cell response in a subject are compared to methods in which the subject is administered with only one CAR (for example, only the first CAR or only the second CAR) and/or the subject is not administered with a mixed population of cells described herein. In embodiments, the mixed population of cells described herein enhances the capabilities (e.g., expansion) of the cells and/or the cell response.

Embodiments relate to a composition and a method for treating a subject having cancer or enhancing T cell response of the subject. The method includes administering to the subject an effective amount of a population of modified cells having a first CAR. The first CAR includes an antigen binding domain, a transmembrane domain, a co-stimulatory domain of CD28, and/or a CD3 zeta domain. The method can further include monitoring and/or measuring one or more parameters of T cell response induced by the modified cells. For example, the one or more parameters include cytokine release, lymphocyte numbers, and a level of CAR T cell expansion and exhaustion. The method can further include administering an effective amount of a population of modified cells including a second CAR to the subject in response to a predetermined time (e.g., one or two weeks after the infusion) and/or condition, which may be associated with the measured parameters (e.g., a copy number of CAR and numbers of CAR T cells). The second CAR includes an antigen binding domain, a transmembrane domain, a co-stimulatory domain of 4-1BB, and/or a CD3 zeta domain. It has been reported that CD28 CAR T cells and 4-1BB CAR T cells behave differently in the lab and in the clinic. Accordingly, the method combines the advantages of the two co-stimulatory domains by coupling the strong initial immune response with the long and persistent immune response. For example, the first CAR including CD28 elicits a robust T cell activation and is associated with effector-like differentiation. While the first CAR can cause T cell exhaustion, it is designed to induce a strong initial response of the subject's immune system. The second CAR including the 4-1BB reduces T cell exhaustion, enhance persistence, and increases central memory differentiation and mitochondrial biogenesis, which are designed for persistent CAR T therapy. In embodiments, the initial response induced by the first CAR can enhance the persistent CAR T therapy. In embodiments, the population of modified cells including the first CAR and the population of modified cells including the second CAR may be administered to the subject at the same time. For example, the composition may include the population of modified cells including the first CAR and the population of modified cells including the second CAR. In embodiments, the first CAR binds an antigen of WBC, and the second CAR binds a solid tumor antigen. In embodiments, the first CAR and the second CAR bind the same or different solid tumor antigens. For example, a population of modified cells including a CAR that binds a solid tumor antigen (e.g., TSHR) and includes 4-1BB co-stimulatory domain and a population of modified cells including a CAR that binds the solid tumor antigen (e.g., TSHR) or another solid tumor antigen (e.g., tMuc1) and includes CD28 co-stimulatory domain were mixed together to obtained a mixed modified cells. In embodiments, the modified cells may be further administered to the subject. In embodiments, the modified cells may be further administered to the subject along with a population of modified cells including a CAR binding a WBC antigen (e.g., CD19).

In embodiments, the CAR molecules described herein comprise one or more complementarity-determining regions (CDRs) for binding an antigen of interest. CDRs are part of the variable domains in immunoglobulins and T cell receptors for binding a specific antigen. There are three CDRs for each variable domain. Since there is a variable heavy domain and a variable light domain, there are six CDRs for binding an antigen. Further since an antibody has two heavy chains and two light chains, an antibody has twelve CDRs altogether for binding antigens. In embodiments, the CAR molecules described herein comprise one or more CDRs for binding antigens. In embodiments, the one or more CDRs bind the antigen of a WBC, such as a B cell. As an example, the one or more CDRs bind CD19, the cell surface antigen of a B cell. In embodiments, the one or more CDRs bind a tumor antigen, for example, tMUC1, TSHR, GUCY2C, ACPP, CLDN18.2 (18.2), PSMA, MAGE A4, or UPK2.

Embodiments further relate to a method of expanding cells or enhancing capabilities (e.g., expansion) of cells, the method comprising: providing a pharmaceutical agent associated with T or NK cells, the agent comprising an antibody binding a white blood cell (WBC) antigen; providing a population of cells comprising an antigen binding molecule targeting a solid tumor antigen; contacting the pharmaceutical agent and the population of cells comprising the antigen binding molecule with an agent comprising the WBC antigen; and allowing the population of cells to expand, wherein expansion of the population of cells is greater than a population of cells that are contacted with the agent comprising the WBC antigen but not with the pharmaceutical agent. In embodiments, the pharmaceutical agent may link a T cell or a NK cell to a WBC such that the WBC function as a presenting cell to activate the T or NK cell or allow the interaction between the WBC and the T or NK cell. In embodiments, the pharmaceutical agent associated with T cells or NK cells comprise a BITE® (Bispecific T cell Engager, an example of a bispecific antibody for example two single chain variable fragments (scFv) connected in tandem by a flexible linker, e.g., a scFv binding the WBC antigen and a scFv binding CD3). In embodiments, the pharmaceutical agent associated with T cells or NK cells comprises a T cell or a NK cell comprising a CAR binding WBC antigen. In embodiments, the pharmaceutical agent comprises a surface (e.g., membrane) or a particle (e.g., a bead) linked the antibody.

Embodiments further relate to a method of expanding modified cells, the method comprising: providing mixed cells comprising a first population of cells comprising a Chimeric Antigen Receptor (CAR) binding a white blood cell (WBC) antigen and a second population of cells comprising an antigen binding molecule targeting a solid tumor antigen; contacting the mixed cells with an agent comprising the WBC antigen; and allowing the second population of cells to expand, wherein expansion of the second population of cells in the mixed cells is greater than a second population of cells in mixed cells that do not include the first population of cells. In embodiments, the method may comprise administering an effective amount of cells comprising an antigen binding molecule (e.g., CAR or TCR) to a subject; and administering an effective amount of presenting agents (e.g., presenting cells) expressing a solid tumor antigen that the binding molecule recognizes, thereby allowing the cells comprising the antigen binding molecule to expand. In embodiments, the method may comprise providing modified cells comprising a CAR binding a WBC antigen and cells comprising an antigen binding molecule targeting a solid tumor antigen; and culturing the first population and the second population T cells in the present of a cell that the CAR binds, thereby allowing the cells comprising the antigen binding molecule to expand.

In embodiments, the agent comprises the WBC antigen attached to a surface. In embodiments, the surface is at least one of a biocompatible, biodegradable, non-biodegradable, natural, or synthetic surface. For example, the surface is a magnetic bead. In embodiments, the bead is capable of activating the first population of cells to release IFN gamma. In embodiments, the agent is a cell comprising the WBC antigen. For example, the agent is a B cell.

In embodiments, the method further comprises allowing the second population of cells to release a cytokine, wherein cytokine release of the second population of cells in the mixed cells is greater than a second population of cells in mixed cells that do not include the first population of cells.

In embodiments, the first population of cells and the second population of cells comprise NK or T cells, or a combination thereof. In embodiments, the agent comprises a cell comprising the WBC antigen or a bead linked to the WBC antigen, or a combination thereof. In embodiments, the antigen binding molecule is a CAR or a TCR, or a combination thereof. In embodiments, the WBC antigen is CD19, CD22, CD20, BCMA, CD5, CD7, CD2, CD16, CD56, CD30, CD14, CD68, CD11 b, CD18, CD169, CD1c, CD33, CD38, CD138, or CD13. In embodiments, the second population of cells in the mixed cells comprise more phenotypes of memory T cells than a second population of cells in mixed that do not include the first population of cells.

In embodiments, the solid tumor antigen is tMUC 1 (tMUC1), PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, B7-H3, MAGE A4, or EGFR.

In embodiments, the CAR comprises an antigen binding domain, a transmembrane domain, a co-stimulatory domain, and a CD3 zeta domain. In embodiments, the co-stimulatory domain comprises an intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that binds CD83, or a combination thereof. In embodiments, the first population of cells or the second population of cells, or a combination thereof, comprises IL6 or IFN-γ, or a combination thereof. In embodiments, the first population of cells or the second population of cells, or a combination thereof, comprises a lentiviral vector encoding a therapeutic agent.

In embodiments, the therapeutic agent comprises a cytokine. In embodiments, the cytokine is at least one of IL6, IL12, TNF-α, or IFN-γ. In embodiments, the first population of cells or the second population of cells, or a combination thereof, comprises a dominant-negative PD-1 form.

In embodiments, the antigen binding molecule is a TCR. In embodiments, the antigen binding molecule is a modified TCR. In embodiments, the TCR is derived from spontaneously occurring tumor-specific T cells in patients. In embodiments, the solid tumor antigen comprises CEA, gp100, MART-1, p53, MAGE-A3, or NY-ESO-1. In embodiments, the TCR comprises TCRγ and TCRδ Chains or TCRα and TCRβ chains, or a combination thereof.

Embodiments relate to an immunotherapeutic system and its use for treating cancer of a subject. As shown in FIG. 77, the immunotherapeutic system 102 (e.g., CoupledCAR®) includes function component 104 configured to inhibit growth of tumor cells, coupling component 106 configured to couple the subject's immune response with the inhibition of the growth of tumor cells, and controlling component 108 configured to control the inhibition and/or coupling. In embodiments, the immunotherapeutic system 102 is a composition comprising one or more pharmaceutical compositions (e.g. antibodies and cells) suitable for treating cancer. It is noted that CoupledCAR® may have various implementations or systems and does not necessarily include CARs or T cells. For example, CoupledCAR® may help other T cell therapy (e.g., TIL or TCR) and NK cell therapy to enhance their expansion and treatment by using BITE® technology, which is described in detail below.

Examples of function component 104 include CAR T, TIL, and TCR and other cellular therapies, an oncolytic virus therapy, a chemotherapy, a tumor vaccine therapy, a metabolism target therapy, and targeted therapy. In embodiments, function component 104 includes at least one of the inhibitors that regulate immune metabolism (e.g., IDO inhibitors and adenosine inhibitors); the immunomodulators (e.g., IMiDs); the agonists against monocytes or dendritic cells (e.g., TLRs/STING); an oncolytic virus therapy; the tumor vaccines (e.g., DC vaccines); the tumor infiltrating T cells (e.g., Tils); the macrophage-reprogramming agents (e.g., CCR2-CCL2 inhibitor, CSF-1Rs inhibitor, PPAR-gamma agonist/inhibitor and CD-40 agonist); the chemotherapy drugs (e.g., cyclophosphamide, fludarabine and ibrutinib); the monoclonal antibody targeting drugs (e.g., anti-her2); or the targeted drugs for non-monoclonal antibodies (e.g., ALK inhibitors, EGF/VEGF inhibitors). Example targets of TCR therapy are listed in Table 3. In embodiments, function component 104 can be implemented by a bispecific antibody such as BITE® molecule (e.g., TSHR-CD3). In embodiment, a bispecific antibody can comprise a first and a second binding domain, wherein the first binding domain binds to a solid tumor antigen, and the second binding domain binds, for example, the T cell CD3 receptor complex or CD28. The second binding domain can also bind other T cell molecules such as 4-1BB, OX40, GTTR, ICOS, NKG20, etc.

Examples of coupling component 106 include immune response elicited by CAR T/NK cells, DC stimulation, T cell stimulation, and antigen/vaccine stimulation. The CAR T/NK cells include the modified cells described in the present disclosure. For example, the modified cell includes a CAR binding an antigen of WBC (e.g., CD19), an antigen of EBV, and/or albumin. T cell stimulation may be implemented using a bispecific antibody (e.g., CD19-CD3). DC cell stimulation may be implemented by administering CAR T/NK cells to the subject, or administering a small molecule, small peptide, vaccine, or antigen to lymphoid organs (e.g., lymph node) of the subject. In embodiment, a bispecific antibody can comprise a first and a second binding domain, wherein the first binding domain binds to an antigen, and the second binding domain binds, for example, the T cell CD3 receptor complex or CD28. The second binding domain can bind other T cell molecules such as 4-1BB, OX40, GITR, ICOS, NKG20, etc. The antigen may bind a WBC antigen (e.g., CD19 and BCMA). In embodiments, CAR T cells can express the bispecific antibody. In embodiments, CAR T cells and the bispecific antibody are administered to the subject at the same time or separately.

In embodiments, uPAR may be used to replace the WBC antigen. The urokinase-type plasminogen activator receptor (uPAR) functions as a cell-surface protein that is broadly induced during senescence and has been shown that uPAR-specific CAR T cells efficiently ablate senescent cells in vitro and in vivo. It has been reported that CAR T cells that target uPAR extend the survival of mice with lung adenocarcinoma that are treated with a senescence-inducing combination of drugs, and restore tissue homeostasis in mice in which liver fibrosis is induced chemically or by diet. Information about uPAR and uPAR CAR can be found in doi.org/10.1038/s41586-020-2403-9, which is incorporated herein by its reference. In embodiments, CART cells targeting a WBC antigen (e.g., CD19) and uPAR CAR T cells may be administered to a subject to treat conditions associated with aging and/or tumor.

In embodiments, the immunotherapeutic system 102 can comprise various bispecific antibodies to treat cancer. In embodiments, the immunotherapeutic system 102 comprises a first bispecific antibody and a second bispecific antibody. The first bispecific antibody can comprise a first and a second binding domain, wherein the first binding domain binds a solid tumor antigen, and the second binding domain binds, for example, the T cell CD3 receptor complex or CD28. The second bispecific antibody can comprise a third and a fourth binding domain, wherein the third binding domain binds an antigen, and the fourth binding domain binds, for example, the T cell CD3 receptor complex or CD28. In embodiments, the immunotherapeutic system 102 comprises modified bispecific antibodies or trispecific antibodies as well as the first bispecific antibody and/or the second bispecific antibody. In these instances, antibody techniques can be used to stimulate cells to secrete one or more cytokines (e.g., IL-6, IL-12, IL-15, IL-7, and IFNγ) in or close to tumor microenvironment. Component 8702 can be implemented to function as a stimulator that stimulate various cells to enhance cytokine releases. For example, the stimulator can comprise agonists or ligands directly or indirectly cause a subject to secrete one or more cytokines (e.g., IL-6, IL-12, IL-7, IL-15, and IFNγ). In embodiments, the first and/or the second bispecific antibodies can be combined with the administration of human recombinant forms of the one or more cytokines. In embodiments, the therapeutic agent can be isolated, synthetic, native, or recombinant human cytokines. In embodiments, administering an effective amount of the human recombinant cytokine comprises intravenous delivery of an amount of IL-6 in the range of about 0.5-50 ug per kilogram of body weight. In embodiments, the human recombinant cytokine comprises IL-6 or IL-7. Recombinant IL-15 can be administered as a daily bolus infusion for a predetermined time or days at 3 mcg/kg/day and 1 mcg/kg/day. Recombinant IFNγ can be administered at a dose of 2 million units daily for 5 days per week over a predetermined time. In embodiments, administering an effective amount of the human recombinant cytokine comprises administering an effective amount of the human recombinant cytokine such that concentrations of the cytokines, such as IL-6 and/or IFN-γ, in the blood of the subject can increase 5-1000 times (e.g., 50 times). Methods of administering IL-6, IL-15, and/or IFNγ can be found in U.S. Pat. No. 5,178,856A and Cytokines in the Treatment of Cancer, Volume 00, Number 00, 2018 of Journal of Interferon & Cytokine Research, which are incorporated herein by reference in their entirety. In embodiments, recombinant IL-12 can be administered at 30 ng/kg as a starting dose and escalated to 500 ng/kg twice weekly after the infusion of CAR T cells. Methods of administering of IL-12 can be found in Leuk Res. 2009 November; 33(11): 1485-1489, which is incorporated here by reference in its entirety. In embodiments, the human recombinant cytokine can be administered to the subject starting from day 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 days after administration.

In embodiments, the coupling component 106 and the function component 104 can be combined and implemented using lentiviral vectors encoding the CAR binding a solid tumor antigen and a superantigen that result in excessive activation of the immune system of the subject. For example, the population of modified cells comprises a lentiviral vector encoding the CAR and a superantigen, the superantigen is Aravan virus Nucleoprotein, Australian bat lyssavirus Nucleoprotein, Duvenhage virus Nucleoprotein, European bat lyssavirus 1 Nucleoprotein, Irkut virus Nucleoprotein, Khujand virus Nucleoprotein, Maize mosaic virus Nucleoprotein, Mokola virus Nucleoprotein, Mouse mammary tumor virus Protein PR73, Rabies virus Nucleoprotein, Rice yellow stunt virus Nucleoprotein, *Staphylococcus aureus* Enterotoxin, Taro vein chlorosis virus Nucleoprotein or West Caucasian bat virus Nucleoprotein. The nucleoproteins may be modified with addition of an extracellular signal peptide. In embodiments, CAR T cells can be combined with bispecific or trispecific antibodies to treat tumors. The CAR T cells can bind a solid tumor antigen. In embodiments, CAR T cells and the antibodies can be administered to the subject at same time or separately. In embodiments, CAR T cells can express the antibodies. The bispecific antibody can comprise a first antibody fragment targeting, for example, CD3, CD28, 41-BB, GITR, or OX40, and a second antibody fragment targeting a solid tumor antigen or a WBC antigen. The trispecific antibodies can comprise a first antibody fragment targeting, for example, CD3, TLR, FcR or NKG2D, a second antibody fragment targeting, for example, CD28, 41-BB, GITR, or OX40, and a third antibody fragment targeting, for example, a WBC antigen or a solid tumor antigen.

The present disclosure also describes a population of modified cells comprising a polynucleotide encoding a CAR and the bispecific antibody or the trispecific antibody described above. The present disclosure also describes a population of modified cell expressing a CAR and the bispecific antibody or the trispecific antibody described above.

Figure 81:
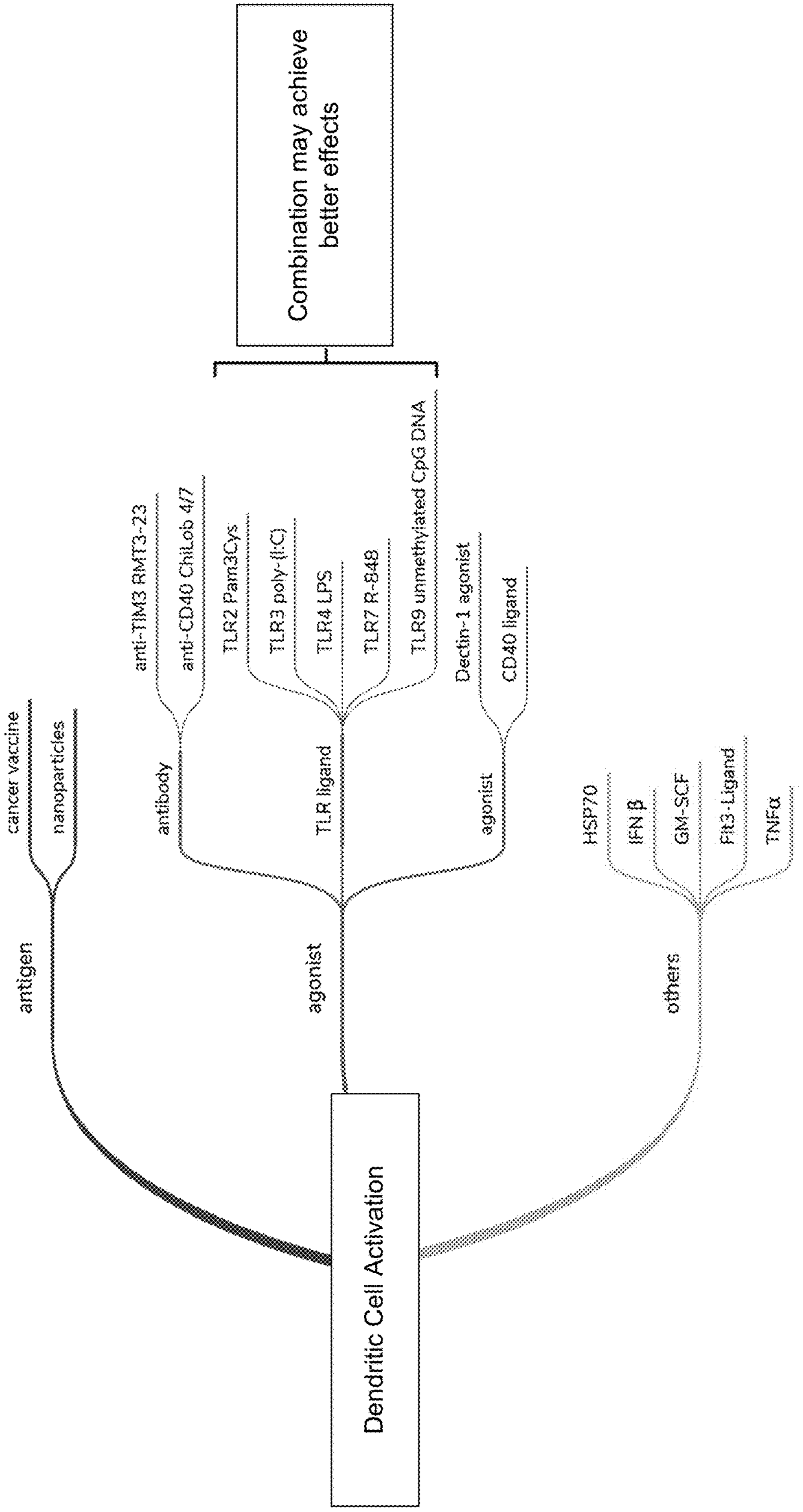
FIG. 81 shows a schematic diagram of exemplary implementations of dendritic cell activation.

As shown in FIG. 81, there are three ways to activate dendritic cells (DCs). The first way is to deliver the antigen (e.g., CEA, PSA or TERT) to the DCs. For example, cancer vaccine or nanoparticles comprising the antigen can activate DCs which in turn can activate the immune system. The second way is by delivering an agonist (e.g., cytokines) to accelerate the DCs' maturation and release related cytokines directly or indirectly. The third way is to deliver cytokines or proteins that helps the activation of DCs. Other methods can also be implemented to activate DCs. For example, DC may be stimulated by various methods such as LPS, various viruses, Plasmodium antigen, cytokines, and vaccine. In embodiments, a small molecule (e.g., CpG oligonucleotides and imiquimod, prototypic drugs) can be associated with an albumin to be delivered to a lymph node to stimulate DCs, which can then selectively cause expansion of CAR T cells homing to the lymph node. The Examples of the present disclosure show that some T cells (e.g., central memory T cells) do not stably remain in the blood after infusions but enter lymphoid organs such as lymph nodes due to molecules such as CCR7 and CD62L on the T cells. Thus, direct and/or indirect stimulation of DCs can selectively expand and/or activate CAR T cells showing more memory-like phenotypes, thus, enhancing efficacy of T therapy. More information about the implementation can be found in Ma et al., Science 365, 162-168 (2019), which is incorporated by reference in its entirety.

Antigen/vaccine stimulation may be implemented by the following embodiments. As an example, the method comprises: administering an effective amount of T cells (e.g., TILs, CAR T, TCR cells) to a subject in need thereof to treat tumor (e.g., solid tumor), and administering an effective amount of an agent that directly or indirectly activates the T cells. In embodiments, the agent includes an antigen that the T cells recognize. In embodiments, the agent includes presenting cells expressing a soluble agent that the extracellular domain of the CAR recognizes. In embodiments, the agent includes vaccines derived from the antigen. For example, the agent includes the antigen associated with albumin such that the agent activates the T cells in, for example, the lymph nodes and then activate DCs, eliciting expansion of the T cells.

Examples of controlling component 108 include a suicide system (e.g., suicide gene), conditional gene expression system (e.g., lac, tetracycline, or galactose systems), and gene modulation system (e.g., Hif1a, NFAT, FOXP3, and/or NFkB).

Figure 78:
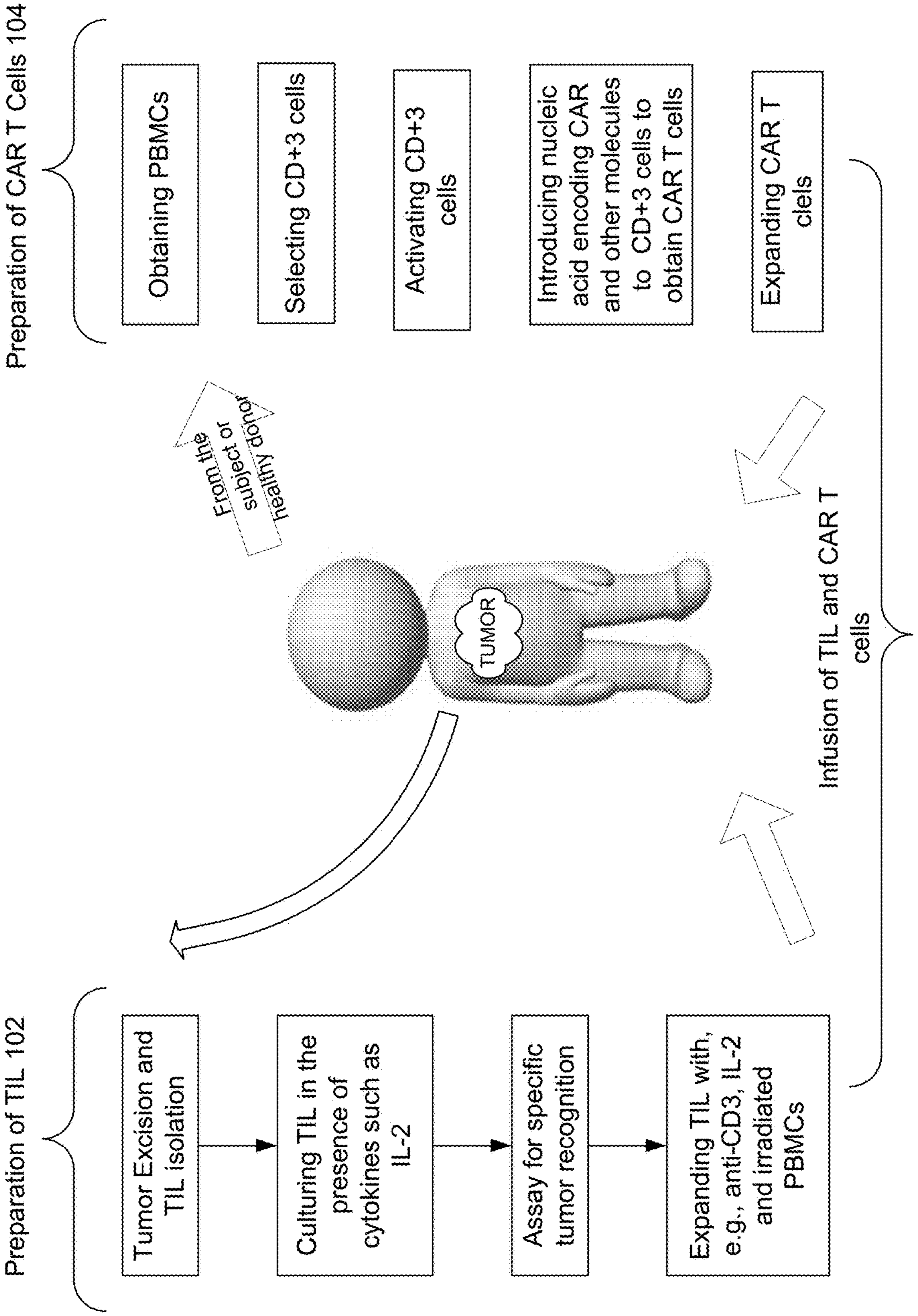
FIG. 78 shows a schematic overview of an exemplary implementation of the immunotherapeutic system in FIG. 77.
Figure 79:
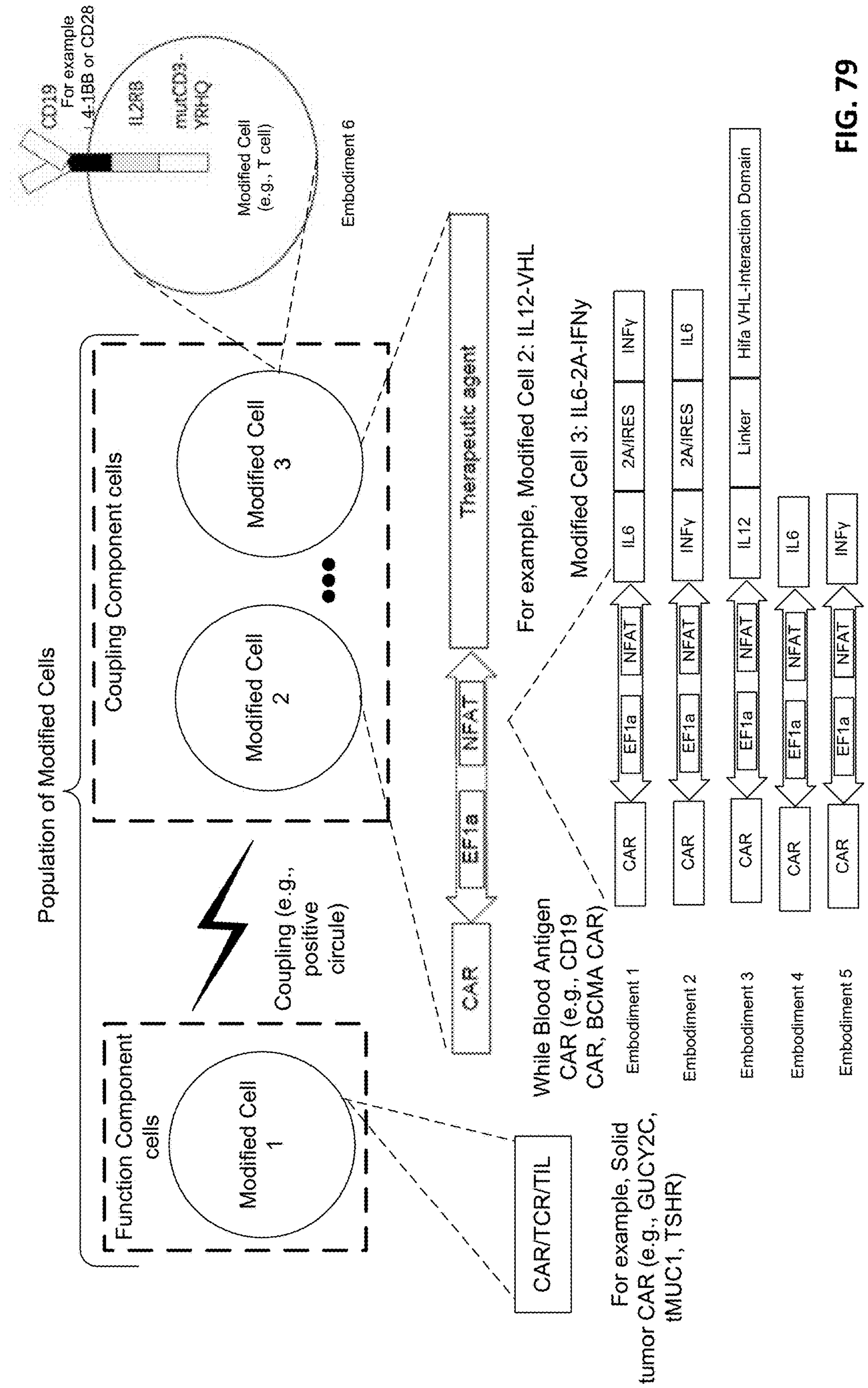
FIG. 79 shows a schematic overview of another exemplary implementation of the immunotherapeutic system in FIG. 77.
Figure 80:
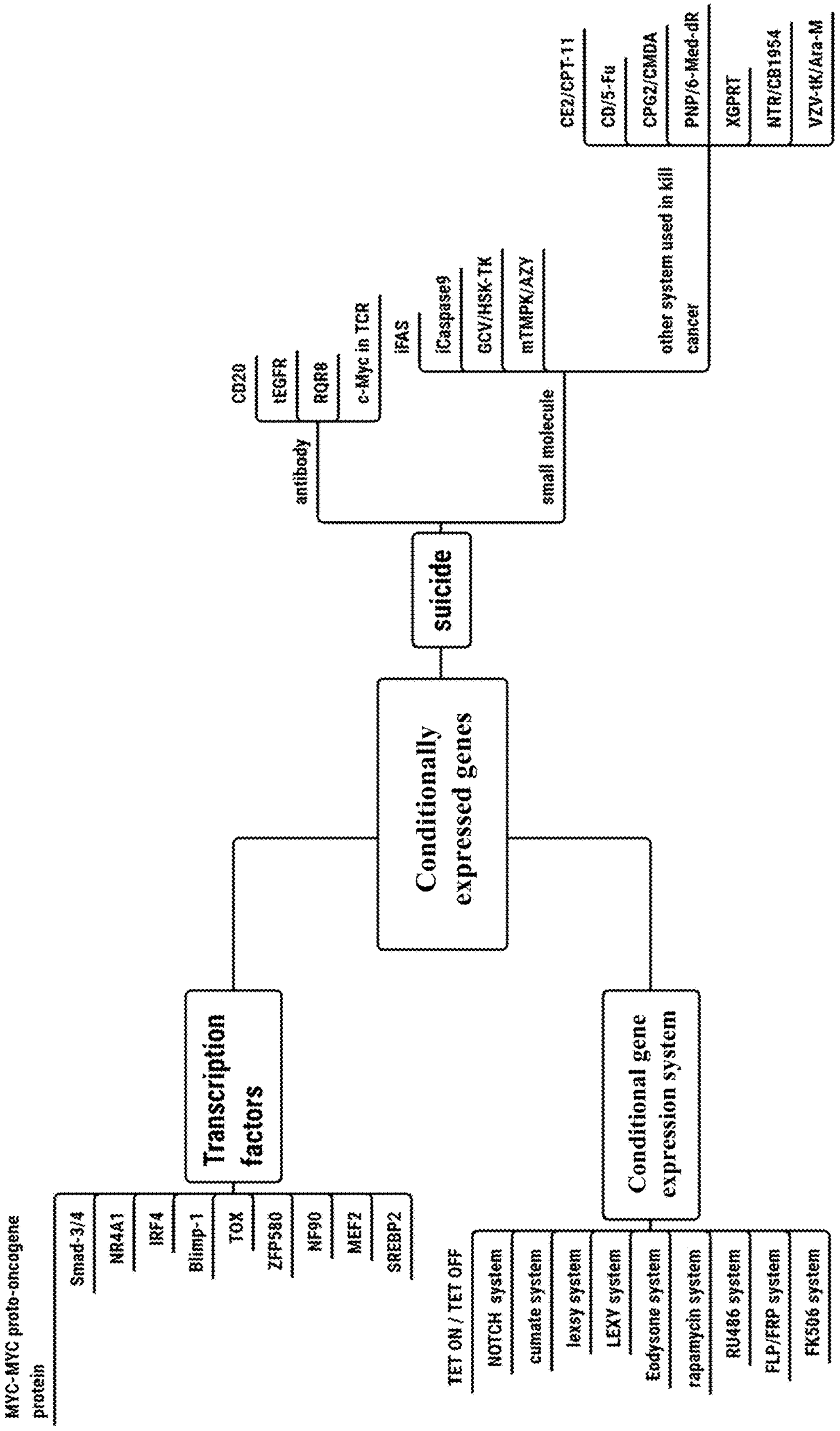
FIG. 80 shows a schematic diagram of exemplary conditional gene expression systems.

FIG. 78 shows an immunotherapeutic system, for example immunotherapeutic system 102. In embodiments, the population of modified cells comprises two types of cells: function component cells and coupling component cells. The function component cells are capable of inhibiting tumor cells. In embodiments, the function components cells include a binding molecule binding a tumor antigen (e.g., a solid tumor antigen). For example, the binding molecule is or includes a CAR or a TCR that binds a solid tumor. In embodiments, the coupling component cells include a CAR targeting a white blood cell antigen. In embodiments, the coupling component cells include modified cells including a nucleic acid sequence encoding IL12 linked to a HIF VHL binding domain, and/or modified cells including a nucleic acid sequence encoding IL6 and IFNγ linked by a 2A peptide.

FIG. 78 shows a schematic overview of an example process for the combination of CAR T cells and tumor-infiltrating lymphocytes (TIL). PBMCs of a subject can be obtained and CART targeting an antigen of WBC (e.g., CD19) can be prepared using various methods described in the present disclosure. In embodiments, the CAR T cells can be Coupling Component cells described in FIG. 77. The subject can then be lymphodepleted. TILs can be prepared using various methods. An example of the methods is the preparation of TIL 102. For example, after excision, the tumor metastasis is digested into a single cell suspension in 24 well plates. These suspensions/fragments are then cultured in the presence of IL-2. In embodiments, the cultures are tested for recognition of autologous melanoma cells (for example, melanoma cell lines or freshly frozen tumor digest, and if not available a panel of HLA-matched allogeneic tumor cell lines), by measuring IFNγ secreted in the medium using an IFNγ ELISA. In embodiments, the selection step for tumor reactivity can be omitted. TIL cultures are then expanded to treatment levels by stimulation with soluble anti-CD3 monoclonal antibody and high concentration of IL-2, and irradiated allogeneic feeder cells. After the TIL cultures are purified to obtain the product cells, the product cells are ready to be infused with CAR T cells that enhance TIL expansion in the subject. Information on TILs preparations may be found in International Application NOs: WO2018/081473 and WO201S/094167 and Molecular Oncology, Volume 9, Issue 10, December 2015, Pages 1918-1935, which are incorporated herein by reference.

There are three theoretical problems that need to be resolved for T cells to overcome solid tumors. The first problem is the identification of the T cells that recognize the tumor. Instead of identifying only one target, it is necessary to identify as many heterogeneous cancer cells as possible. In this regard, TIL (Tumor Infiltrating T Lymphocyte) Therapy seems promising. The second challenge is to allow these screened T cells that recognize tumors to overcome the suppression of the tumor microenvironment. The third challenge is to allow these screened population of T cells that recognize tumors and overcome the microenvironmental inhibition and expand sufficiently to fight advanced tumors and reverse the course of the disease. Ordinary TIL technology is amplified in large quantities in vitro, but at a high cost and long cycles. Excessive costs can lead to high drug prices in the future, and too long a cycle can make advanced cancer patients unable to afford, which will challenge future applications of the product to treatment. Accordingly, Immunotherapeutic system 102 can be helpful for the latter two challenges. Coupling component 106 can couple a subject's immune response with TIL therapy, for example, to expand TILs in the subject, reducing the cost and shortening the cycle associated with the TIL therapy and/or overcoming the suppression of the tumor microenvironment by maintaining the population of TILs in the subject.

Embodiments relate to a method of activating and/or expanding cells, the method comprising: providing a population of lymphocytes comprising T cells or NK cells; providing a population of Antigen-presenting cells (APCs); stimulating the population of APCs cells; contacting the population of lymphocytes with the population of APCs; and allowing the population of lymphocytes to be activated and/or expanded. In embodiments, the APCs comprise dendritic cells, macrophages, Langerhans cells and B cells, or T cells. Embodiments also relates to a method of activating and/or expanding cells, the method comprising: providing a population of lymphocytes comprising T cells or NK cells; providing a population of B cells; stimulating the population of B cells; contacting the population of lymphocytes with the population of B cells; and allowing the population of lymphocytes to be activated and/or expanded. Embodiments also relates to a method of activating and/or expanding cells, the method comprising: providing a population of lymphocytes comprising T cells or NK cells, the lymphocytes comprising an antigen binding molecule binding a solid tumor antigen; providing a population of B cells; stimulating the population of B cells; contacting the population of lymphocytes with the stimulated population of B cells; and allowing the population of lymphocytes to be activated and/or expanded without contacting the solid tumor antigen.

In embodiments, the stimulating the population of APCs or B cells comprises stimulating the population of APCs or B cells such that the expression of CD68 and/or CD80 of at least a portion of the population APCs or B cells increase. In embodiments, the stimulating the population of APCs or B cells comprises contacting the population of B cells with antibodies against a B cell antigen. In embodiments, rein the antibodies comprise a scFv against the B cell antigen. In embodiments, the stimulating the population of B cells comprises contacting the population of B cells with a CAR binding a B cell antigen. In embodiments, the stimulating the population of B cells comprises contacting the population of B cells with a bispecific antibody against a B cell antigen. In embodiments, the contacting the population of lymphocytes and the population of APCs or B cells comprises contacting the population of lymphocytes with the population of APCs or B cells such that CD40 of the APCs and B cells bind CD40L of the lymphocytes.

Embodiments also relate to a method of activating and/or expanding cells, the method comprising: providing mixed cells comprising a population of lymphocytes and a population of antigen-presenting cells (APCs); contacting the mixed cells with an agent capable of stimulating or activating the APCs; and allowing the population of lymphocytes to be activated and/or expanded.

Embodiments also relate to a method of activating and/or expanding cells, the method comprising: providing mixed cells comprising a population of lymphocytes and a population of antigen-presenting cells (APCs); stimulating or activating the APCs; and allowing the population of lymphocytes to be activated and/or expanded. In embodiments, the stimulating or activating the APCs comprises introducing a polynucleotide encoding a molecule (e.g., a transcriptional factor) into the population of lymphocytes such that the population of lymphocytes may directly or indirectly stimulate the APCs. Examples of the molecule may be found single cell RNA (scRNA) profiling described in this Application and in U.S. patent application Ser. No. 16/936,874, which is incorporated herein by reference in its entirety.

In embodiments, the APCs comprise at least one of dendritic cells, macrophages, Langerhans cells and B cells, or T cells. In embodiments, the APCs comprise B cells.

In embodiments, allowing the population of cells including lymphocytes to be activated and/or expanded include cultivating or growing the lymphocytes in the presence of stimulated cells, such as stimulated APCs or B cells, and under conditions that enable the cells, such as lymphocytes, to be expanded and/or activated. In embodiments, allowing the population of lymphocytes to be activated and/or expanded comprises allowing the population of lymphocytes to be and/or expanded without contacting an antigen that the lymphocytes bind.

The term "agent" as described herein includes various molecules depending on the context or how the agent is being used. As an example, "an agent" used in stimulating and activating and/or expanding cells include agents that are capable of stimulating and activating and/or expanding cells. An agent that can activate and/or expand cells can include a CAR T cell, an antibody, a cytokine, an antigen, a soluble antigen, or a therapeutic molecule. In embodiments, an agent used in expanding lymphocytes comprises at least one or more of a CAR T cell binding a B cell, a bispecific antibody binding a B cell and a T cell, an antibody binding a B cell, or a cytokine capable of differentiating a B cell into a plasma cell. In embodiments, the agent comprises an antibody binding a B cell. In embodiments, the agent can be used to modulate transcriptional factors in lymphocytes, including T cells and NK cells. The agent can be a cytokine that induces the overexpression of transcriptional factors, such as Hif1a, NFAT, FOXP3, and/or NFkB. In embodiments, the agent can also reduce the expression of certain molecules in T cells and NK cells.

In embodiments, the agent comprises a scFv binding a B cell. In embodiments, the lymphocytes comprise T cells or NK cells, or a combination thereof. In embodiments, the agent binds a B cell antigen. In embodiments, the B cell antigen comprises at least one or more of CD19, CD20, CD22, CD53, CD138, BCMA, CD38, or FCRL5. In embodiments, the stimulating or activating the APCs comprises stimulating or activating the APCs to up-regulate CD80 and/or CD86 on the APCs. In embodiments, the stimulating or activating the APCs comprises stimulating or activating the APCs to up-regulate CD40 on the APCs. In embodiments, the population of lymphocytes comprise T cells and/or NK cells. In embodiments, the population of lymphocytes comprises a CAR or TCR.

Embodiments also relate to a method of activating and/or expanding T lymphocytes, the method comprising: providing a first multiple-specific antibodies comprising an antigen binding domain binding a WBC antigen and an antigen binding domain binding a T cell antigen; providing a second multiple-specific antibodies comprising an antigen domain binding a tumor antigen and an antigen binding domain binding a T cell antigen; and contacting APCs and the T lymphocytes with the first multiple-specific antibodies and the second multiple-specific antibodies; and allowing the lymphocytes to be activated and/or expanded.

Embodiments also relate to a composition comprising a first multiple-specific antibodies comprising an antigen binding domain binding a WBC antigen and an antigen binding domain binding a T cell antigen and a second multiple-specific antibodies comprising an antigen domain binding a tumor antigen and an antigen binding domain binding a T cell antigen. In embodiments, an amount of the first multiple-specific antibodies is less than the second multiple-specific antibodies. For example, a CoupledCAR® system may include the first and second multiple specific antibodies (e.g., BiTE®s), wherein the first multiple specific antibodies may activate APCs (e.g., B cells) and allow the lymphocytes to be activated and/or expanded, thereby enhancing the treatment of the second multiple specific antibodies on a solid tumor corresponding to the second multiple specific antibodies. An example of the CoupledCAR® system includes a CD3-CD19 bispecific antibody and a CD3-Solid tumor antigen bispecific antibody.

In embodiments, the expansion of the lymphocytes is enhanced as compared with lymphocytes contacted with the second multiple-specific antibodies without the first multiple-specific antibodies. In embodiments, the APCs comprise at least one of dendritic cells, macrophages, Langerhans cells and B cells, or T cells. In embodiments, the APCs comprise B cells. In embodiments, the lymphocytes comprise T cells or NK cells, or a combination thereof. In embodiments, the WBC antigen is a B cell antigen. In embodiments, the WBC antigen comprises at least one or more of CD19, CD20, CD22, CD53, CD138, BCMA, CD38, or FCRL5. In embodiments, the lymphocytes comprise T cells and/or NK cells. In embodiments, the tumor antigen is selected from a group consisting of: MUC1 (tMUC1), PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, CLDN 18.2, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, MAGE A4, or EGFR. In embodiments, the first multiple-specific antibodies are bispecific antibodies binding CD3 and CD19. In embodiments, the second multiple-specific antibodies are bispecific antibodies binding CD3 and a solid tumor antigen. In embodiments, the first and/or second multiple-specific antibodies comprise an agonist or a ligand of a co-stimulation molecule. In embodiments, the co-stimulation molecule comprises one or more of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CDS, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKp44, NKp30, NKp46, or NKG2D.

The present disclosure is further described by reference to the following exemplary embodiments and examples. These exemplary embodiments and examples are provided for purposes of illustration only and are not intended to be limiting unless otherwise specified. Thus, the present disclosure should in no way be construed as being limited to the following exemplary embodiments and examples, but rather, should be construed to encompass any and all variations which become evident as a result of the teaching provided herein. Sequences described in the Examples and Embodiments are listed in Table 2.

TABLE 2

| Sequence IDs and Corresponding Identifiers | | | | | |
|---|---|---|---|---|---|
| Name | SEQ ID NO: | Name | SEQ ID NO: | Name | SEQ ID NO: |
| SP, SP-2, CD8sp | 1 | VL2 VH 1 SIGLEC-15-CAR-6 | 145 | CAR 2 of MUC1-5E5-A-IRES-CD14-B | 230 |
| Hinge & transmembrane domain | 2 | VL2 VH2 SIGLEC-15-CAR-7 | 146 | CAR 2 of MUC1-2-A-IRES-CD14-B | 230 |
| Co-stimulatory domain (4-1BB-2) | 3 | VL2 VH3 SIGLEC-15-CAR-8 | 147 | CAR 2 of MUC1-2-B-IRES-CD14-B | 230 |
| CD3-zeta, CD3 zeta-2 | 4 | VL2 VH4 SIGLEC-15-CAR-9 | 148 | Construct of MUC1-2-A-IRES-CD14-A | 231 |
| scFv Humanized CD19 | 5 | VL1 SIGLEC-15-CAR | 149 | Construct of MUC1-2-B-IRES-CD14-A | 232 |
| scFv CD19 CD14-B | 6 | VL2 SIGLEC-15-CAR | 150 | Construct of MUC1-2-A-IRES- | 233 |
| scFv FZD10 | 7 | VH1 SIGLEC-15-CAR | 151 | Construct of MUC1-2-B-IRES-CD14-B | 234 |
| scFv TSHR | 8 | VH2 SIGLEC-15-CAR | 152 | Construct of MUC1-5E5-A-IRES-BCMA-A | 235 |
| scFv PRLR | 9 | VH3 SIGLEC-15-CAR | 153 | CAR 2 of MUC1-5E5-A-IRES-BCMA-A | 236 |
| scFv Muc 17 | 10 | VH4 SIGLEC-15-CAR | 154 | CAR 2 of MUC1-5E5-B-IRES-BCMA-A | 236 |
| scfv GUCY2C, scfv GUCY2C LH | 11 | MUC16-CAR-1 | 155 | CAR 2 of MUC1-2-A-IRES-BCMA-A | 236 |
| scFv CD207 | 12 | scFv MUC16-CAR-1 | 156 | CAR 2 of MUC1-2-B-IRES-BCMA-A | 236 |
| Prolactin (ligand) | 13 | scFv VL MUC16-CAR-1 | 157 | CAR 2 of MUC1-5E5-B-IRES-BCMA-B | 236 |
| scFv CD3 | 14 | scFv VH MUC16-CAR-1 | 158 | Construct of MUC1-5E5-B-IRES-BCMA-A | 237 |
| scFv CD4 | 15 | MUC16-CAR-2 | 159 | Construct of MUC1-5E5-A-IRES-BCMA-B | 238 |
| scFv CD4-2 | 16 | scFv MUC16-CAR-2 | 160 | CAR 2 of MUC1-2-A-IRES-BCMA-B | 239 |
| scFv CD5 | 17 | scFv VL MUC16-CAR-2 | 161 | MUC1-2-B-IRES-BCMA-B CAR 2 | 239 |
| CD19 antigen | 18 | scFv VH MUC16-CAR-2 | 162 | CAR 2 of MUC1-5E5-A-IRES-BCMA-B | 239 |
| FZD10 antigen | 19 | KISS1R-CAR | 163 | Construct of MUC1-5E5-B-IRES-BCMA-B | 240 |

TABLE 2-continued

| Name | SEQ ID NO: | Name | SEQ ID NO: | Name | SEQ ID NO: |
|---|---|---|---|---|---|
| Sequence IDs and Corresponding Identifiers | | | | | |
| TSHR antigen | 20 | Ligent peptide KISS1R-CAR | 164 | Construct of MUC1-2-A-IRES-BCMA-A | 241 |
| PRLR antigen | 21 | ZFLm1 (left) RS aa | 165 | Construct of MUC1-2-B-IRES-BCMA-A | 242 |
| Muc 17 antigen | 22 | ZFLm1 (left) F1 | 166 | Construct of MUC1-2-A-IRES-BCMA-B | 243 |
| GUCY2C antigen | 23 | ZFLm1 (left) F5 | 166 | Construct ofMUC1-2-B-IRES-BCMA-B | 244 |
| CD207 antigen | 24 | ZFLm1 (left) F2 | 167 | Construct of MUC1-5E5-A-IRES-CD33-A | 245 |
| CD3 antigen | 25 | ZFLm1 (left) F3 | 168 | CAR 2 of MUC1-2-A-IRES-CD33-A | 246 |
| CD4 antigen | 26 | ZFLm1 (left) F4 | 169 | CAR 2 of MUC1-2-B-IRES-CD33-A | 246 |
| CD5 antigen | 27 | ZFLm1 (left) F6 | 170 | CAR 2 of MUC1-5E5-A-IRES-CD33-A | 246 |
| CAR CD19 nucleic acid | 28 | ZFRm1-4 (right) RS aa | 171 | CAR 2 of MUC1-5E5-B-IRES-CD33-A | 246 |
| Hinge & TM domain B | 29 | ZFRm1-4 (right) F1 | 172 | MUC1-5E5-B-IRES-CD33-A | 247 |
| Hinge & TM domain A | 30 | ZFRm1-4 (right) F2 | 173 | Construct of MUC1-5E5-A-IRES-CD33-B | 248 |
| Hinge & TM domain D | 31 | ZFRm1-4 (right) F3 | 174 | CAR 2 of MUC1-2-A-IRES-CD33-B | 249 |
| Hinge domain D | 32 | ZFRm1-4 (right) F4 | 175 | CAR 2 of MUC1-2-B-IRES-CD33-B | 249 |
| Hinge domain C | 32 | δ chain-1 of Vγ9Vδ2 | 176 | CAR 2 of MUC1-5E5-A-IRES-CD33-B | 249 |
| Hinge domain B | 33 | γ chain-2 of Vγ9Vδ2 | 177 | CAR 2 of MUC1-5E5-B-IRES-CD33-B | 249 |
| Hinge domain A | 33 | δ chain-2 of Vγ9Vδ2 | 178 | Construct ofMUC1-5E5-B-IRES-CD33-B | 250 |
| TM domain D | 34 | Vγ9Vδ2 TCR-1: DG. SF13 γ chain | 179 | Construct ofMUC1-2-A-IRES-CD33-A | 251 |
| TM domain A | 34 | Vγ9Vδ2 TCR-1: DG. SF13 δ chain | 180 | Construct ofMUC1-2-B-IRES-CD33-A | 252 |
| CD19 extracellular domain | 35 | Vγ9Vδ2 TCR-2: DG. SF68: γ chain | 181 | Construct ofMUC1-2-A-IRES-CD33-B | 253 |
| TM domain C | 36 | Vγ9Vδ2 TCR-2: DG. SF68: δ chain | 182 | Construct ofMUC1-2-B-IRES-CD33-B | 254 |
| TM domain B | 36 | Vγ9Vδ2 TCR-3: 12G12: γ chain | 183 | Mcu1-5e5Panko-enhanced scFc | 255 |

TABLE 2-continued

Sequence IDs and Corresponding Identifiers

| Name | SEQ ID NO: | Name | SEQ ID NO: | Name | SEQ ID NO: |
|---|---|---|---|---|---|
| WTCD3zeta | 37 | Vγ9Vδ2 TCR-3: 12G12: δ chain | 184 | Mcu1-Panko5e5 - enhanced scFc | 256 |
| WTCD3zeta-BCMACAR full length | 38 | Vγ9Vδ2 TCR-4: CP.1.15 γ chain | 185 | Mcu1-5e5Panko-enhanced scFc A 41BB CD2 zeta | 257 |
| BCMA | 39 | TCR-4: CP.1.15δ chain | 186 | Mcu1-5e5Panko-enhanced scFc B 41BB CD2 zeta | 258 |
| BCMA CAR vector | 40 | WT CD3-zeta | 187 | Mcu1-5e5Panko-enhanced scFc C 41BB CD2 zeta | 259 |
| BCMA CAR vector | 41 | Invariant sequence for iNKT α chain (hVα24-JαQ-TRAC) | 188 | Mcu1-5e5Panko-enhanced scFc D 41BB CD2 zeta | 260 |
| VL anti-CD5 | 42 | An example for iNKT β chain sequence (containing Vβ11): | 189 | Mcu1-Panko5e5-enhanced scFc A 41BB CD2 zeta | 261 |
| VH anti-CD5 | 43 | Invariant sequence for MAIT α chain (hAV7S2-AJ33 α chain) (version1) | 190 | Mcu1-Panko5e5-enhanced scFc B 41BB CD2 zeta | 262 |
| VL anti-CD4 | 44 | VH anti- CD4-2 | 191 | Mcu1-Panko5e5-enhanced scFc C 41BB CD2 zeta | 263 |
| VH anti-CD4 | 45 | Construct of MUC1-5E5-A-IRES-CD19-A | 192 | Mcu1-Panko5e5-enhanced scFc D 41BB CD2 zeta | 264 |
| VL anti-CD3 | 46 | CAR 1 of MUC1-5E5-A-IRES-CD33-B | 193 | GS linker | 265 |
| VH anti-CD3 | 47 | CAR 1 of MUC1-5E5-A-IRES-CD19-A | 193 | Construct of TSHR CAR | 266 |
| TSHR extracellular domain | 48 | CAR 1 of MUC1-5E5-A-IRES-CD33-A | 193 | PSCA-CAR ScFv | 267 |
| VH region of BCMA scFv | 49 | CAR 1 of MUC1-5E5-A-IRES-CD19-B | 193 | Anti-TSHR-VL | 268 |
| VL region of BCMA scFv | 50 | CAR 1 of MUC1-5E5-A-IRES-hCD19-A | 193 | Anti-TSHR-VH | 269 |
| VH region of CD14 scFv | 51 | CAR 1 of MUC1-5E5-A-IRES-hCD19-B | 193 | 4*GGGGS bispecific CAR linker | 270 |
| VL region of CD14 scFv | 52 | CAR 1 of MUC1-5E5-A-IRES-CD22-A | 193 | humanized-anti CD19-VH | 271 |
| VH region of CD33 scFv | 53 | MUC1-5E5-A-IRE5-CD22-B CAR | 193 | B7-H3 scFv 1 | 272 |

TABLE 2-continued

Sequence IDs and Corresponding Identifiers

| Name | SEQ ID NO: | Name | SEQ ID NO: | Name | SEQ ID NO: |
|---|---|---|---|---|---|
| VL region of CD33 scFv | 54 | CAR 1 of MUC1-5E5-A-IRES-CD14-A | 193 | B7-H3 scFv 2 | 273 |
| CD22CAR | 55 | CAR 1 of MUC1-5E5-A-IRES-CD14-B | 193 | B7-H3 scFv 3 | 274 |
| BCMACAR | 56 | CAR 1 of MUC1-5E5-A-IRES-BCMA-A | 193 | Anti- CLDN 18.2 (175) -VL | 275 |
| MUC1CAR | 57 | CAR 1 of MUC1-5E5-A-IRES-BCMA-B | 193 | Anti- CLDN 18.2 (175) -VH | 276 |
| m19CAR-IRES-MUC1CAR | 58 | CAR 2 of MUC1-5E5-B-IRES-CD19-A | 194 | CLDN 18.2 (175) CAR Binding domain | 277 |
| hCD19CAR-IRES-MUC1CAR | 59 | CAR 2 of MUC1-2-A-IRES-CD19-A | 194 | tMUC1-CLDN 18.2 tanCAR binding domain 175/5e5LH | 278 |
| hCD22CAR-IRES-MUC1CAR | 60 | CAR 2 of MUC1-2-B-IRES-CD19-A | 194 | tMUC1-CLDN 18.2 tanCAR binding domain 175/5e5HL | 279 |
| BCMACAR-IRES-MUC1CAR | 61 | CAR 2 of MUC1-5E5-A-IRES-CD19-A | 194 | tMUC1-CLDN 18.2 tanCAR binding domain 163/5e5LH | 280 |
| mCD19CAR-2A-MUC1CAR | 62 | Construct of MUC1-5E5-B-IRES-CD19-A | 195 | tMUC1-CLDN 18.2 tanCAR binding domain 163/5e5HL | 281 |
| hCD19CAR-2A-MUC1CAR | 63 | CAR 1 of MUC1-5E5-B-IRES-CD33-A | 196 | tMUC1-CLDN 18.2 tanCAR binding domain 5e5/175LH | 282 |
| hCD22CAR-2A-MUC1CAR | 64 | CAR 1 of MUC1-5E5-B-IRES-BCMA-B | 196 | tMUC1-CLDN 18.2 tanCAR binding domain 5e5/175HL | 283 |
| BCMA-2A-MUC1CAR | 65 | CAR 1 of MUC1-5E5-B-IRES-CD33-B | 196 | tMUC1-CLDN 18.2 tanCAR binding domain 5e5/163LH | 284 |
| Tumor associated MUC1 scFv 1 | 66 | CAR 1 of MUC1-5E5-B-IRES-CD19-A, | 196 | tMUC1-CLDN 18.2 tanCAR binding domain 5e5/163HL | 285 |
| Tumor associated MUC1 scFv-1 VH | 67 | CAR 1 of MUC1-5E5-B-IRES-CD19-B | 196 | tMUC1-CLDN 18.2 tanCAR 175/5e5LH-1 | 286 |
| Tumor associated MUC1 scFv-1 VL | 68 | CAR 1 of MUC1-5E5-B-IRES-hCD19-A | 196 | tMUC1-CLDN 18.2 tanCAR 175/5e5HL-1 | 287 |
| Tumor associated MUC1 scFv-1 VL CDR 1 | 69 | CAR 1 of MUC1-5E5-B-IRES-hCD19-B | 196 | tMUC1-CLDN 18.2 tanCAR 163/5e5LH-1 | 288 |
| L2D8-2 (hCAR VL) | 70 | CAR 1 of MUC1-5E5-A-IRES-CD22-A | 196 | tMUC1-CLDN 18.2 tanCAR 163/5e5HL-1 | 289 |
| humanized-anti CD19-VL | 70 | CAR 1 of MUC1-5E5-B-IRES-CD22-B | 196 | tMUC1-CLDN 18.2 tanCAR 5e5/175LH-1 | 290 |

TABLE 2-continued

| Sequence IDs and Corresponding Identifiers | | | | | |
|---|---|---|---|---|---|
| Name | SEQ ID NO: | Name | SEQ ID NO: | Name | SEQ ID NO: |
| Tumor associated MUC1 scFv-1 VL CDR 3 | 71 | CAR 1 of MUC1-5E5-B-IRES-CD14-A | 196 | tMUC1-CLDN 18.2 tanCAR 5e5/175HL-1 | 291 |
| Tumor associated MUC1 scFv-1 VH CDR 1 | 72 | CAR 1 of MUC1-5E5-B-IRES-BCMA-A | 196 | tMUC1-CLDN 18.2 tanCAR 5e5/163LH-1 | 292 |
| Tumor associated MUC1 scFv-1 VH CDR 2 | 73 | Construct of MUC1-5E5-A-IRES-CD19-B | 197 | tMUC1-CLDN 18.2 tanCAR 5e5/163HL-1 | 293 |
| Tumor associated MUC1 scFv-1 VH CDR 3 | 74 | CAR 2 of MUC1-5E5-A-IRES-CD19-B | 198 | tMUC1-CLDN 18.2 tanCAR 175/5e5LH-2 | 294 |
| Tumor associated MUC1 scFv2 | 75 | CAR 2 of MUC1-5E5-B-IRES-CD19-B | 198 | tMUC1-CLDN 18.2 tanCAR 175/5e5HL-2 | 295 |
| Tumor associated MUC1 scFv2 VH | 76 | CAR 2 of MUC1-2-A-IRES-CD19-B | 198 | tMUC1-CLDN 18.2 tanCAR 163/5e5LH-2 | 296 |
| Tumor associated MUC1 scFv2 VL | 77 | CAR 2 of MUC1-2-B-IRES-CD19-B | 198 | tMUC1-CLDN 18.2 tanCAR 163/5e5HL-2 | 297 |
| Tumor associated MUC1 scFv-2 VL CDR 1 | 78 | Construct of MUC1-5E5-B-IRES-CD19-B | 199 | tMUC1-CLDN 18.2 tanCAR 5e5/175LH-2 | 298 |
| Tumor associated MUC1 scFv-2 VL CDR 2 | 79 | Construct of MUC1-2-A-IRES-CD19-A | 200 | tMUC1-CLDN 18.2 tanCAR 5e5/175HL-2 | 299 |
| Tumor associated MUC1 scFv-2 VL CDR 3 | 80 | CAR 1 of MUC1-2-A-IRES-CD33-A | 201 | tMUC1-CLDN 18.2 tanCAR 5e5/163LH-2 | 300 |
| 'Tumor associated MUC1 scFv-2VH CDR 1 | 81 | CAR 1 of MUC1-2-A-IRES-CD19-A | 201 | tMUC1-CLDN 18.2 tanCAR 5e5/163HL-2 | 301 |
| Tumor associated MUC1 scFv-2 VH CDR 2 | 82 | CAR 1 of MUC1-2-A-IRES-CD19-B | 201 | scfv CD19 HL | 302 |
| Tumor associated MUC1 scFv-2 VH CDR 3 | 83 | CAR 1 of MUC1-2-A-IRES-hCD19-A | 201 | scfv TSHR LH | 303 |
| GSTA motif | 84 | CAR 1 of MUC1-2-A-IRES-hCD19-B | 201 | scfv TSHR HL | 304 |
| Modified PD-1 intracellular domain -1 | 85 | CAR 1 of MUC1-2-A-IRES-CD22-A | 201 | scfv GUCY2C HL | 305 |
| Modified PD-1 intracellular domain -2 | 86 | MUC1-2-A-IRES-CD22-B CAR 1 | 201 | scfv ACPP LH | 306 |
| Modified PD-1 intracellular domain -3 | 87 | CAR 1 of MUC1-2-A-IRES-CD14-A | 201 | scfv ACPP HL | 307 |

TABLE 2-continued

Sequence IDs and Corresponding Identifiers

| Name | SEQ ID NO: | Name | SEQ ID NO: | Name | SEQ ID NO: |
|---|---|---|---|---|---|
| Modified PD-1 intracellular domain -4 | 88 | CAR 1 of MUC1-2-A-IRES-CD33-B | 201 | scfv UPK2 LH (1) | 308 |
| Modified PD-1 intracellular domain -5 | 89 | CAR 1 of MUC1-2-A-IRES-CD14-B | 201 | scfv UPK2 HL (1) | 309 |
| Removed PD-1 intracellular domain -1 | 90 | CAR 1 of MUC1-2-A-IRES-BCMA-A | 201 | scfv UPK2 LH (2) | 310 |
| Removed PD-1 intracellular domain -2 | 90 | CAR 1 of MUC1-2-A-IRES-BCMA-B | 201 | scfv UPK2 HL (2) | 311 |
| Fokl WC | 91 | Construct of MUC1-2-B-IRES-CD19-A | 202 | scfv PSMA LH | 312 |
| M-Fokl, M Fokl-1 | 92 | CAR 1 of MUC1-2-B-IRES-CD33-A | 203 | scfv PSMA HL | 313 |
| M-Fokl, M Fokl-2 | 93 | CAR 1 of MUC1-2-B-IRES-CD33-B | 203 | anti CXCR5 Scfv | 314 |
| γ chain-1 of Vγ9V52 | 94 | CAR 1 of MUC1-2-B-IRES-BCMA-B | 203 | Anti DPEP3 Scfv | 315 |
| VL anti-CD4-2 | 95 | CAR 1 of MUC1-2-B-IRES-CD19-A | 203 | hCD19-CAR (4-1BB + CD3 zeta) -NATF-IL6-2A-IFNγ | 316 |
| UPK2 | 96 | CAR 1 of MUC1-2-B-IRES-CD19-B | 203 | NFAT6x + minimal IL12 promoter | 317 |
| ADAM12 | 97 | CAR 1 of MUC1-2-B-IRES-hCD19-A | 203 | IL-6 aa Sequence | 318 |
| SLC45A3 | 98 | CAR 1 of MUC1-2-B-IRES-hCD19-B | 203 | 2A | 319 |
| ACPP | 99 | MUC1-2-B-IRES-CD22-A CAR 1 | 203 | IFN-γ aa | 320 |
| MUC21 | 100 | CAR 1 of MUC1-2-B-IRES-CD22-B | 203 | hCD19-CAR (4-1BB + CD3 zeta)-NATF-IL12-VHL | 321 |
| MUC16 | 101 | CAR 1 of MUC1-2-B-IRES-CD14-A | 203 | IL12 aa | 322 |
| MS4A12 | 102 | CAR 1 of MUC1-2-B-IRES-CD14-B | 203 | Hif VHL-interaction domain: Hif amino acid 344-417 | 323 |
| ALPP | 103 | CAR 1 of MUC1-2-B-IRES-BCMA-A | 203 | GUCY2C-CAR | 324 |
| SLC2A14 | 104 | Construct of MUC1-2-A-IRES-CD19-B | 204 | scFv 6503 S5D1 | 325 |
| GS1-259H13.2 | 105 | Construct of MUC1-2-B-IRES-CD19-B | 205 | 163: cldn18.2 scfv: CD8-signal peptide + cldn18.2VL + GS linker + cldn18.2VH | 326 |
| ERVFRD-1 | 106 | Construct of MUC1-5E5-A-IRES-hCD19-A | 206 | 6921: ACPP scFv: CD8-signal peptide + acpp-VL + GS linker + acpp-VH | 327 |

TABLE 2-continued

Sequence IDs and Corresponding Identifiers

| Name | SEQ ID NO: | Name | SEQ ID NO: | Name | SEQ ID NO: |
|---|---|---|---|---|---|
| ADGRG2 | 107 | CAR 2 of MUC1-5E5-A-IRES-hCD19-A | 207 | 2517: tMUC1, cldn18.2 tanCAR | 328 |
| ECEL1 | 108 | CAR 2 of MUC1-5E5-B-IRES-hCD19-A | 207 | 2519: tMUC1, cldn18.2 tanCAR | 329 |
| CHRNA2 | 109 | CAR 2 of MUC1-2-A-IRES-hCD19-A | 207 | 2521: TSHR, tMUC1 tanCAR | 330 |
| GP2 | 110 | Construct of MUC1-2-B-IRES-hCD19-A | 207 | 2529: ACPP, tMUC1 tanCAR | 331 |
| PSG9 | 111 | Construct of MUC1-5E5-B-IRES-hCD19-A | 208 | 2530: ACPP, tMUC1 tanCAR | 332 |
| SIGLEC15 | 112 | Construct of MUC1-5E5-A-IRES-hCD19-B | 209 | 2533: ACPP, tMUC1 tanCAR | 333 |
| SLC6A3 | 113 | CAR 2 of MUC1-5E5-A-IRES-hCD19-B | 210 | 2534: ACPP, tMUC1 tanCAR | 334 |
| KISS1R | 114 | CAR 2 of MUC1-5E5-B-IRES-hCD19-B | 210 | scFv target PSMA | 335 |
| QRFPR | 115 | CAR 2 of MUC1-2-A-IRES-hCD19-B | 210 | scFv target Mesothelin | 336 |
| GPR119 | 116 | CAR 2 of MUC1-2-B-IRES-hCD19-B | 210 | scFv target EGFRvIII | 337 |
| CLDN6 | 117 | Construct of MUC1-5E5-B-IRES-hCD19-B | 211 | scFv target CEA | 338 |
| Linker-2 (3*GGGGS linker) | 118 | Construct of MUC1-2-A-IRES-hCD19-A | 212 | scFv target Glypican-3 | 339 |
| Hinge-2 | 119 | Construct of MUC1-2-B-IRES-hCD19-A | 213 | scFv target IL-13 | 340 |
| TM-2 | 120 | Construct of MUC1-2-A-IRES-hCD19-B | 214 | CD8a + 41BB | 341 |
| CLDN6-CAR-1 | 121 | Construct of MUC1-2-B-IRES-hCD19-B | 215 | CD8a + CD27 | 342 |
| ScFv CLDN6-CAR-1 | 122 | Construct of MUC1-5E5-A-IRES-CD22-A | 216 | CD8a + CD44 | 343 |
| ScFv VL CLDN6-CAR-1 | 123 | CAR 2 of MUC1-5E5-A-IRES-CD22-A | 217 | TNFRSF14 | 344 |
| ScFv VH CLDN6-CAR-1 | 124 | CAR 2 of MUC1-5E5-A-IRES-CD22-A | 217 | IL2RB-stat5 | 345 |
| CLDN6-CAR-2 | 125 | CAR 2 of MUC1-2-A-IRES-CD22-A | 217 | IL2RB (truncated) | 346 |
| ScFv CLDN6-CAR-2 | 126 | MUC1-2-B-IRES-CD22-A CAR 2 | 217 | IL12RB1 (stat1) | 347 |
| ScFv VL CLDN6-CAR-2 | 127 | Construct of MUC1-5E5-B-IRES-CD22-A | 218 | IL12RB2 (stat4) | 348 |

TABLE 2-continued

Sequence IDs and Corresponding Identifiers

| Name | SEQ ID NO: | Name | SEQ ID NO: | Name | SEQ ID NO: |
|---|---|---|---|---|---|
| ScFv VH CLDN6-CAR-2 | 128 | Construct of MUC1-5E5-A-IRES-CD22-B | 219 | IL21R (stat1 or stat3) | 349 |
| CLDN6-CAR-3 | 129 | MUC1-5E5-A-IRES-CD22-B CAR 2 | 220 | IFNGR1 | 350 |
| scFv CLDN6-CAR-3 | 130 | CAR 2 of MUC1-5E5-B-IRES-CD22-B | 217 | IFNGR2 | 351 |
| scFv VL CLDN6-CAR-3 | 131 | MUC1-2-A-IRES-CD22-B CAR 2 | 217 | IL4R (STAT6) | 352 |
| scFv VH CLDN6-CAR-3 | 132 | CAR 2 of MUC1-2-B-IRES-CD22-B | 217 | CD3z-wt | 353 |
| CLDN6-CAR-4 | 133 | MUC1-5E5-B-IRES-CD22-B | 221 | CD3z-YRHQ | 354 |
| scFv CLDN6-CAR-4 | 134 | Construct of MUC1-2-A-IRES-CD22-A | 222 | CD3z-mut(P→F)-truncated | 355 |
| scFv VL CLDN6-CAR-4 | 135 | MUC1-2-B-IRES-CD22-A | 223 | CD3z-mut(P→F)-truncated-YRHQ | 356 |
| scFv VH CLDN6-CAR-4 | 136 | MUC1-2-A-IRES-CD22-B | 224 | CD3z-mut(P→F) | 357 |
| SIGLEC-15-CAR-1 | 137 | Construct of MUC1-2-B-IRES-CD22-B | 225 | CD3z-mut(P→F)-YRHQ | 358 |
| scFv SIGLEC-15-CAR-1 | 138 | Construct of MUC1-5E5-A-IRES-CD14-A | 226 | CD3-CD19 Bispecific Antibody | 359 |
| scFv VL SIGLEC-15-CAR-1 | 139 | CAR 2 of MUC1-5E5-A-IRES-CD14-A | 227 | JAK binding motif (amino acids 13 to 21) | 360 |
| scFv VH SIGLEC-15-CAR-1 | 140 | CAR 2 of MUC1-5E5-B-IRES-CD14-A | 227 | Exogenous STAT3 association motif | 361 |
| VL1 VH1 SIGLEC-15-CAR-2 | 141 | CAR 2 of MUC1-2-A-IRES-CD14-A | 227 | Exogenous STAT3 association motif | 362 |
| VL1 VH2 SIGLEC-15-CAR-3 | 142 | CAR 2 of MUC1-2-B-IRES-CD14-A | 227 | STATS association motif | 363 |
| VL1 VH3 SIGLEC-15-CAR-4 | 143 | Construct of MUC1-5E5-B-IRES-CD14-A | 228 | TRAcdr3 | 364 |
| VL1 VH 4 SIGLEC-15-CAR-5 | 144 | Construct of MUC1-5E5-A-IRES-CD14-B | 229 | TRBcdr3 | 365 |

3*GGGGS is $(GGGGS)_3$(SEQ ID NO: 118) and 4*GGGGS is $(GGGGS)_4$(SEQ ID NO: 270)

CD8sp-- tMUC1-VL--3*GGGGS linker-- tMUC1-VH--4*GGGGS bispecific CAR linker-- humanized-CD19-VH--3*GGGGS linker--humanized-CD19-VL (2501)

CD8sp-- tMUC1-VL--3*GGGGS linker-- tMUC1-VH--4*GGGGS bispecific CAR linker-- humanized-CD19-VL--3*GGGGS linker-- humanized- CD19-VH (2504)

CD8sp-- humanized- CD19-VL--3*GGGGS linker-- humanized- CD19-VH --4*GGGGS bispecific CAR linker-- tMUC1-VL--3*GGGGS linker-- tMUC1-VH CD8sp-- humanized-CD19-VL--3*GGGGS linker-- humanized- CD19-VH --4*GGGGS bispecific CAR linker-- tMUC1-VH--3*GGGGS linker-- tMUC1-VL

TABLE 3

| Example Targets of TCR Therapy | |
|---|---|
| TCL1 | B cell lymphoma |
| NY-ESO-1 | Urinary squamous cell carcinoma/melanoma |
| MAGA1/2/3 | Lung cancer/pancreatic cancer/gastric cancer/ breast cancer |
| MAGE A3/A6/A10/A12 | Lung cancer/pancreatic cancer/gastric cancer/ breast cancer |
| HPV-16 E6/E7 | Cervical cancer/head and neck cancer/anal cancer |
| WT-1 | MDS & AML |
| SSX2 | Hepatocellular carcinoma/melanoma/prostate cancer |
| KRAS | Multiple malignant tumors |
| Neoantigen | Multiple malignant tumors |
| LMP7 | Brain cancer/HIV infection/cervical cancer in situ, cutaneous basal cell arcinoma or squamous cell carcinoma, localized prostate cancer or ductal carcinoma in situ |
| AFP | In theory, CAR T cells' targets (film surface) are also possible (as long as TCR can recognize). |
| HA1 | Multiple malignant tumors |
| P53 | Multiple leukemia + lymphoma |
| GP100 | Multiple malignant tumors |
| LMP1, LMP2 and EBNA1 | Melanoma |
| MCPyV | EBV |
| CEA | Merkel cell cancer |
| LAGE-1A | Multiple malignant tumors |
| MART-1 | Urinary squamous cell carcinoma/melanoma |

Exemplary Embodiments

The following are exemplary embodiments:

1. A fusion protein (e.g., polyspecific antibody) comprising: a first antigen binding domain targeting a receptor of a first immune cell; a second antigen binding domain targeting a receptor of a second immune cell; and a third antigen binding domain targeting a tumor antigen.
2. A composition comprising: a first fusion protein (e.g., polyspecific antibody) comprising a first antigen binding domain targeting a receptor of a first immune cell and an antigen binding domain targeting a tumor antigen; and a second antigen binding domain targeting a receptor of a second immune cell and an antigen binding domain targeting a tumor antigen.
3. The composition of embodiment 2, wherein the first immune cell is a T cell, and the second immune cell is a DC.
4. The fusion protein of any preceding suitable embodiments, wherein the fusion is a bispecific or a trispecific antibody.
5. The fusion protein of any preceding suitable embodiments, wherein the receptor of the first immune cell and the receptor of the second immune cell are selected from receptors in the below immune cell's receptors such as monocyte/CD16, CD32, CD64, Mannose receptor (MR), Scavenger receptor (SR), Toll-like receptor (TLR), Phosphatidylserine receptor (PSR), CD14, CD40; NK cell/CD16, NKp46, NKp30, NKp44, NKp80, NKG2D, KIR-S, CD94/NKG2C, CRACC, Ly9, CD84, NTBA, CD3Z, 41BB, CD28, 2B4; imDC/Complement receptor, FcR, MR, TLR; mDC/Basic granulocyte, FcεRI, Acid granulocyte, FcεRI, Mast cells, FcεRI, FcγRIII; NKT/γδT cell; Innate lymphoid cell/Neutrophil; Dectin-1, Mac-1, TREM-1, TLR1, TLR2, TLR3, TLR4, TLR5, TLR6, TLR7, TLR8, TLR9, TLR10, NOD1, NOD2, CR4, CR1(CD35), FcγR; T cell/CD3, CD28, 41BB, and OX40.
6. The fusion protein of any preceding suitable embodiments, wherein the fusion protein further comprises a therapeutic agent (such as a cytokine), and information of antibody cytokine fusion proteins can be found at J Biotechnol. 2018 April 10; 271: 29-36., which is incorporated by reference in its entirety.
7. The fusion protein of embodiment 6, wherein the therapeutic agent comprises or is a cytokine or one of other anti-tumor molecules such as chemotherapy payload.
8. The fusion protein of embodiment 7, wherein the cytokine comprises or is at least one of IL-12, IL-6, and IFNγ.
9. The fusion protein of any preceding suitable embodiments, wherein the first antigen binding domain comprises an agonistic antibody corresponding to the receptor of the first immune cell, and/or the second antigen binding domain comprises an agonistic antibody corresponding to the receptor of the second immune cell.
10. A polynucleotide encoding the fusion protein of any preceding suitable embodiments.
11. A host cell comprising the fusion protein of any preceding suitable embodiments.
12. A modified cell comprising the fusion protein of any preceding embodiments.
13. A method for treating or cause a T cell response in a subject having cancer, the method comprising administering an effective amount of the composition comprising modified cells of embodiment 12.
14. A method for treating cancer, cause a T cell response in a subject having the cancer, or enhancing the T cell response, the method comprising administering an effective amount of the composition comprising modified cells of embodiment 12.
15. A method for treating or cause a T cell response in a subject having cancer, the method comprising administering an effective amount of the composition comprising fusion proteins of any preceding suitable embodiments.
16. A method for treating cancer, cause a T cell response in a subject having the cancer, or enhancing the T cell response, the method comprising administering an effective amount of the composition comprising fusion proteins of any preceding suitable embodiments
17. A method for enhancing or causing the T cell response, the method comprising administering an effective amount of the composition of a fusion protein and a modified cell comprising a CAR or TCR, wherein the fusion protein is bispecific or trispecific antibody that bind CD3 and a tag, the CAR or TCR is associated with the tag.
18. A method for enhancing or causing the T cell response, the method comprising administering an effective amount of the composition of a fusion protein and a modified cell comprising a CAR or TCR, wherein the fusion protein comprises a binding domain binding bind CD3 and comprises a tag, the CAR/TCR binds the tag.
19. A method for enhancing or causing T cell response, the method comprising administering an effective amount of a composition of a modified cell that comprises a polynucleotide encoding a polyspecific antibody of any preceding suitable embodiments and a polynucleotide encoding a CAR/TCR that binds a solid tumor antigen.
20. The method of embodiment 19, wherein the polyspecific antibody comprise a bispecific antibody comprising a binding domain binding a WBC (white blood antigen) antigen and a binding domain binding CD3.

21. The method of embodiment 19, wherein the modified cell comprises a polynucleotide encoding one or more therapeutic agents (e.g., IL-12, IL-6, and IFNγ).

22. A method for enhancing or causing T cell response, the method comprising administering an effective amount of a composition of a modified cell that comprises a polynucleotide encoding a polyspecific antibody of any preceding suitable embodiments and a polynucleotide encoding a CAR/TCR that binds a non-essential tissue antigen (e.g., GCC, TSHR, PAP), the polyspecific antibody binds CD3 and a tumor specific antigen (e.g., MUC1 and EGFRVIII), the modified cell expresses and secretes the polyspecific antibody.

23. The method of embodiment 22, wherein the composition further comprises modified cells comprising a polynucleotide encoding a WBC CAR (e.g., CD19 CAR).

24. The method of embodiment 22, wherein the modified cell further expresses and secretes a polyspecific antibody that bind CD19 and CD3.

25. A method for enhancing or causing T cell response, the method comprising administering an effective amount of a composition of a modified cell that comprises a polynucleotide encoding a polyspecific antibody of any preceding suitable embodiments and a polynucleotide encoding a CAR/TCR that binds a tumor specific antigen (e.g., MUC1 and EGFRVIII), the polyspecific antibody binds CD3 and a non-essential tissue antigen (e.g., GCC, TSHR, PAP), the modified cell expresses and secretes the polyspecific antibody.

26. The method of embodiment 25, wherein the composition further comprises modified cells comprising a polynucleotide encoding a WBC CAR (e.g., CD19 CAR).

27. The method of embodiment 26, wherein the modified cell further expresses and secretes a polyspecific antibody that bind CD19 and CD3.

28. A method for enhancing or causing T cell response, the method comprising administering an effective amount of a composition of a modified cell that comprises a CAR/TCR binding a solid tumor antigen and a composition of a modified cell engineered to express and secrete the solid tumor antigen.

29. The method of embodiment 28, wherein the solid tumor antigen is a non-essential tissue antigen.

30. The modified cell of any of the preceding embodiments, wherein the enhanced expression and/or function of the one or more molecules is implemented by introducing a nucleic acid sequence encoding the one or more molecules and/or the binding molecule, which is present in the modified cell in a recombinant DNA construct, in an mRNA, or in a viral vector.

31. The modified cell of embodiment 30, wherein the nucleic acid sequence is an mRNA, which is not integrated into the genome of the modified cell.

32. The modified cell of embodiment 30, wherein the nucleic acid sequence is associated with an oxygen-sensitive polypeptide domain.

33. The modified cell of embodiment 30, wherein the oxygen-sensitive polypeptide domain comprises HIF VHL binding domain.

34. The modified cell of embodiment 30, wherein the nucleic acid sequence is regulated by a promoter comprising a binding site for a transcription modulator that modulates the expression and/or secretion of the therapeutic agent in the cell.

35. The modified cell of embodiment 34, wherein the transcription modulator is or includes Hif1a, NFAT, FOXP3, and/or NFkB.

36. The modified cell of any of preceding embodiments, wherein the one or more molecules comprise at least one of G-CSF or GM-CSF, or a combination thereof.

37. The modified cell of any of preceding embodiments, wherein the one or more molecules comprise at least one of a receptor of G-CSF or GM-CSF, or a combination thereof.

38. The modified cell of any of preceding embodiments, wherein the one or more molecules comprise at least one of IL-33, IL-1β, TNFα, MALP-2, IL1, and IL17.

39. A polynucleotide encoding the one or more molecules of any proceeding embodiments and an antigen binding molecule.

40. The modified cell of any of the preceding embodiments, wherein the modified cell comprises the antigen binding molecule, the antigen binding molecule is chimeric antigen receptor (CAR), which comprises an antigen-binding domain, a transmembrane domain, and an intracellular signaling domain.

41. The modified cell of embodiment 40, wherein the antigen-binding domain binds to a tumor antigen is selected from a group consisting of: TSHR, CD19, CD123, CD22, CD30, CD171, CS-1, CLL-1, CD33, EGFRvIII, GD2, GD3, BCMA, Tn Ag, PSMA, ROR1, FLT3, FAP, TAG72, CD38, CD44v6, CEA, EPCAM, B7H3, KIT, IL-13Ra2, Mesothelin, IL-11Ra, PSCA, PRSS21, VEGFR2, LewisY, CD24, PDGFR-beta, SSEA-4, CD20, Folate receptor alpha, ERBB2 (Her2/neu), MUC1, EGFR, NCAM, Prostase, PAP, ELF2M, Ephrin B2, IGF-I receptor, CAIX, LMP2, gp100, bcr-abl, tyrosinase, EphA2, Fucosyl GM1, sLe, GM3, TGSS, HMWMAA, o-acetyl-GD2, Folate receptor beta, TEM1/CD248, TEM7R, CLDN6, GPRCSD, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, legumain, HPV E6, E7, MAGE A1, ETV6-AML, sperm protein 17, XAGE1, Tie 2, MAD-CT-1, MAD-CT-2, Fos-related antigen 1, p53, p53 mutant, prostein, survivin and telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYP1B1, BORIS, SART3, PAX5, OY-TES1, LCK, AKAP-4, SSX2, RAGE-1, human telomerase reverse transcriptase, RU1, RU2, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, and IGLL1.

42. The modified cell of any one of embodiments 40 and 41, wherein the intracellular signaling domain comprises a co-stimulatory signaling domain, or a primary signaling domain and a co-stimulatory signaling domain, wherein the co-stimulatory signaling domain comprises a functional signaling domain of a protein selected from the group consisting of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CDS, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKp44, NKp30, NKp46, and NKG2D 43. The modified cell of any one of embodiments 16-30, wherein the modified cell comprises the antigen binding molecule, the antigen binding molecule is a modified TCR.

44. The modified cell of embodiment 43, wherein the TCR is derived from spontaneously occurring tumor-specific T cells in patients.

45. The modified cell of embodiment 44, wherein the TCR binds to a tumor antigen.

46. The modified cell of embodiment 45, wherein the tumor antigen comprises CEA, gp100, MART-1, p53, MAGE-A3, or NY-ESO-1.

47. The modified cell of embodiment 45, wherein the TCR comprises TCRγ and TCRδ Chains or TCRα and TCRβ chains, or a combination thereof.

16. The modified cell of any of the preceding embodiments, wherein the cell is an immune cell (e.g., a population of immune effector cells).

48. The modified cell of embodiment 16, wherein the immune cell is a T cell or an NK cell.

49. The modified cell of embodiment 48, wherein the immune effector cell is a T cell.

50. modified cell of embodiment 49 wherein the T cell is a CD4+ T cell, a CD8+ T cell, or a combination thereof.

51. The modified cell of any of the preceding embodiments, wherein the cell is a human cell.

52. The modified cell of any proceeding embodiments, wherein the modified cell comprises a nucleic acid sequence encoding a binding molecule and a dominant negative form of an inhibitory immune checkpoint molecule or a receptor thereof.

53. The modified cell of embodiment 52, wherein the inhibitory immune checkpoint molecule is selected from the group consisting of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIRD, natural killer cell receptor 2B4 (2B4), and CD 160.

54. The modified cell embodiment 52, wherein inhibitory immune checkpoint molecule is modified PD-1.

55. The modified cell of embodiment 54, wherein the modified PD-1 lacks a functional PD-1 intracellular domain for PD-1 signal transduction, interferes with a pathway between PD-1 of a human T cell of the human cells and PD-L1 of a certain cell, comprises or is a PD-1 extracellular domain or a PD-1 transmembrane domain, or a combination thereof, or a modified PD-1 intracellular domain comprising a substitution or deletion as compared to a wild-type PD-1 intracellular domain, or comprises or is a soluble receptor comprising a PD-1 extracellular domain that binds to PD-L1 of a certain cell.

56. The modified cell of any proceeding embodiments, wherein the modified cell is engineered to express and secrete a therapeutic agent such as a cytokine.

49. The modified cell of embodiment 48, wherein the therapeutic agent that is or comprises IL-6 or IFN-γ, or a combination thereof.

57. The modified cell of embodiment 56, wherein the therapeutic agent that is or comprises IL-15 or IL-12, or a combination thereof.

51 The modified cell of any of embodiments 48-50, wherein the small protein or the therapeutic agent is or comprises a recombinant or native cytokine.

52 The modified cell of embodiment 48, wherein the small protein is or comprises IL-12, IL-6 or IFN-γ.

58. The modified cell of any proceeding embodiments, wherein the modified cell is derived form a healthy donor or the subject having the cancer.

59. The modified cell of embodiment 58, wherein the modified ell has a reduced expression of endogenous TRAC gene.

60. The modified cell of any proceeding embodiments, wherein the modified cell comprises a first CAR binding a white blood antigen and a second CAR binding a solid tumor antigen.

61. The modified cell of any proceeding embodiments, wherein the modified cell comprises a bispecific CAR binding a white blood antigen and a solid tumor antigen.

62. A pharmaceutical composition comprising a population of the modified cells of embodiments 1-54 and a population of additional modified cells, wherein the modified cells bind a first antigen, and the additional modified cells bind a second antigen, which is different form the first antigen.

63. The pharmaceutical composition of embodiment 62, wherein the first antigen is a white blood cell antigen, and the second antigen is a solid tumor antigen.

64. The pharmaceutical composition of embodiment 62, wherein the second antigen is a white blood cell antigen, and the first antigen is a solid tumor antigen.

65. The pharmaceutical composition of embodiments 63 or 64, wherein the white blood cell antigen is CD19, CD22, CD20, BCMA, CD5, CD7, CD2, CD16, CD56, CD30, CD14, CD68, CD11b, CD18, CD169, CD1c, CD33, CD38, CD138, or CD13.

66. The pharmaceutical composition of embodiments 63 or 64, wherein is CD19, CD20, CD22, or BCMA.

67. The pharmaceutical composition of embodiments 63 or 64, wherein the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, CLDN18.2, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, B7-H3, or EGFR.

68. The pharmaceutical composition of embodiments 63 or 64, wherein the solid tumor antigen comprises tumor associated MUC1, ACPP, TSHR, GUCY2C, UPK2, CLDN18.2, PSMA, DPEP3, CXCR5, B7-H3, MUC16, SIGLEC-15, CLDN6, Muc17, PRLR, and FZD10.

69. A method of eliciting or enhancing T cell response, treating a subject in need thereof or enhancing cancer treatment thereof, the method comprising administering an effective amount of the pharmaceutical composition of any of embodiments 62-68.
70. A method for treating a subject having cancer, wherein the method comprising:
    inducing TILs out of tumor tissues using a mobilizer like GCSF or GMCSF;
    administering an effective amount of CART cells targeting a WBC antigen (e.g., CD19) or a bispecific antibody (e.g., Anti-CD19/Anti-D3) targeting the WBC antigen or a T cell antigen such that the TILs are expanded in the human body, in a non-tumor environment, to achieve anti-cancer.
71. The method of embodiment 70, wherein the CAR T cells or the bispecific antibody comprises a cytokine.
72. A modified cell comprising:
    a chimeric antigen receptor (CAR), wherein the CAR comprises an extracellular domain, a transmembrane domain, and an intracellular domain, the extracellular domain comprising an extracellular domain of a receptor of a homing molecule, the intracellular domain comprising an intracellular domain of a T cell activation molecule; and
    an additional CAR targeting a solid tumor antigen.
73. An isolated nucleic acid sequence encoding a chimeric antigen receptor (CAR), wherein the CAR comprises an extracellular domain, a transmembrane domain, and an intracellular domain, the extracellular domain comprising an extracellular domain of a receptor of a homing molecule, the intracellular domain comprising an intracellular domain of a T cell activation molecule.
74. A population of CAR cells comprising the CAR of embodiment 73.
75. A pharmaceutical composition comprising the population of the CAR cells of embodiment 2.
76. A method of cause T cell response in a subject in need thereof and/or treating a tumor of the subject, the method comprising administering an effective amount of the composition of embodiment 75 to the subject.
77. A modified cell comprising a chimeric antigen receptor (CAR), wherein the CAR comprises an extracellular domain, a transmembrane domain, and an intracellular domain, the extracellular domain comprising an extracellular domain of a receptor of a homing molecule, the intracellular domain comprising an intracellular domain of a T cell activation molecule. 78. The isolated nucleic acid sequence or the modified cell of any of embodiments 73-77, wherein the homing molecule is CCR2, CCR4, CXCR3, CCR6, ICAM3, CCR7, LFA-3, CCR1, CCR3, or CCR5.
79. The isolated nucleic acid sequence or the modified cell of any of embodiments 73-77, wherein the T cell activation molecule is CD27, CD28, 4-IBB(CD137), OX40, GITR, CD30, CD40, ICOS, BAFFR, HVEM, ICAM-1, lymphocyte function-associated antigen-1 (LFA-1), CD2, CDS, CD7, CD287, LIGHT, NKG2C, NKG2D, SLAMF7, NKp80, NKp30, NKp44, NKp46, CD160, or B7-H3.
80. The isolated nucleic acid sequence or the modified cell of any of embodiments 73-77, wherein the transmembrane membrane is CD28, CD3 epsilon, CD45, CD4, CD5, CD8, CD9, CD16, CD22, CD33, CD37, CD64, CD80, CD86, CD134, CD137, or CD154.

81. The isolated nucleic acid sequence or the modified cell of any of embodiments 74-80, wherein the modified cell or cells comprise an additional CAR binds to an antigen.
82. The isolated nucleic acid sequence or the modified cell of embodiment 81, wherein the intracellular domain of the additional CAR comprises a costimulatory signaling region that comprises an intracellular domain of a costimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.
83. The isolated nucleic acid sequence or the modified cell of embodiment 81, wherein the antigen is Epidermal growth factor receptor (EGFR), Variant III of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Rα2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1 or MUC 1), Folate receptor-α (FR-α), CD19, FZD10, TSHR, PRLR, MUC 17, GUCY2C, CD207, CD3, CD5, B-Cell Maturation Antigen (BCMA), or CD4.
84. The isolated nucleic acid sequence or the modified cell of any of embodiments 72-83, wherein the transmembrane domain of the CAR comprises a transmembrane domain of a T cell receptor.
85. A method of enhancing T-cell response in body of a subject, the method comprising: administering the subject an effective amount of a population of lymphocytes comprising an antigen binding molecule and one or more agents that enhance capabilities (e.g., expansion) of lymphocytes comprising the antigen binding molecule in the subject.
86. The method of embodiment 85, wherein the T-cell response comprises capabilities (e.g., expansion) or activation of the lymphocytes and/or anti-tumor efficacy of immunotherapy in the subject.
87. The method of embodiment 85, wherein the one or more agents or the lymphocytes comprise a CAR comprising an extracellular domain binding a WBC antigen, a transmembrane domain, and an intracellular domain comprising a co-stimulatory domain and a domain associated with the signaling of IL2RB (e.g., JAK-STAT domain).
88. The method of embodiment 85, wherein the one or more agents or the lymphocytes comprise a CAR comprising an extracellular domain binding a tag, a transmembrane domain, and an intracellular domain comprising a co-stimulatory domain and a JAK-STAT signaling domain or a domain associated thereof (upstream and downstream). More about the JAK-STAT signaling domain can be found at Nat Med. 2018 March; 24(3): 352-359. doi:10.1038/nm.4478, which is incorporated here by its reference.
89. The method of embodiment 88, further comprising:
    administering effective amount of a fusion protein comprising a tag and Anti-CD40 or CD40L.
90. The method of embodiments 87 or 88, wherein the CAR does not comprise CD3 zeta domain such that WBC would be killed.

91. A polynucleotide encoding the CAR of any of embodiment 87-89.
92. A vector comprising the polynucleotide of embodiment 6.
93. A cell comprising the polynucleotide of embodiment 6.
94. A CAR of any of embodiment 87-89.
95. The method or any preceding suitable embodiments, wherein the one or more agents enhance function of a co-stimulatory signaling pathway of the lymphocytes and/or a cytokine receptor.
96. The method of embodiment 95, wherein the enhancement is inducible.
97. The method of embodiment 95, wherein the enhancement is controlled by the binding of the lymphocytes and a WBC or binding of the CAR.
98. The method of any of embodiments 95-97, wherein the co-stimulatory signaling pathway comprises CD80/CD86, CD40, or 4-1BB, and the cytokine receptor is an IL-2 receptor.
99. The method of any preceding suitable embodiments, wherein the one or more agents up-regulates or enhance maintenance of function and/or expression of CD80/CD86 of the lymphocytes, and/or the one or more agents up-regulates or enhance maintenance of function and/or expression of IL-2 receptor (e.g., CD25) of the lymphocytes.
100. The method of any preceding suitable embodiments, wherein the one or more agents comprise a secretable IL-2.
101. The method of embodiment 16 or 17, wherein the up-regulation or enhancement is inducible.
102. The method of embodiment 101, wherein the up-regulation or enhancement is controlled by the binding of the lymphocytes and a WBC or binding of the CAR.
103. The method or any preceding suitable embodiments, wherein the one or more agents cause an addition or disruption of one or more genes of the lymphocytes, which is implemented by ZFN, Cas9, or TLAEN, and/or the lymphocytes further comprise a polynucleotide encoding a therapeutic agent (e.g., a cytokine) under control of a regulatory element (e.g., NFAT, HIF etc.).
104. The method of any preceding embodiments, wherein the binding molecule is the CAR, the method further comprises administering the subject an effective amount of another population of lymphocytes comprising a CAR or TCR binding a solid tumor antigen, and the number of the other population of lymphocytes is greater than the population of lymphocytes.
105. The method of any preceding embodiments, wherein the lymphocytes are T cells, DCs, macrophages, and/or NK cells.
106. The method of any preceding embodiments, wherein the antigen binding molecule is CAR or TCR targeting an antigen associated with the cancer described in any preceding suitable embodiments.
107. The method of any preceding embodiments, wherein the lymphocytes are T cells, and the antigen binding molecule is a CAR targeting a solid tumor antigen.
108. A method of enhancing or eliciting T-cell response or enhancing treatment of or treating a subject having cancer, the method comprising:

administering the subject an effective amount of a population of lymphocytes (e.g., T cells or NKs) comprising an antigen binding molecule binding a solid tumor antigen; and activating or enhancing functions or activities of the lymphocytes' co-stimulatory signaling domain;

activating or enhancing functions or activities of IL-2 signaling pathway.

109. The method of embodiment 108, wherein the activating or enhancing functions or activities of the lymphocytes' co-stimulatory signaling domain comprising activating or enhancing functions or activities of the lymphocytes' co-stimulatory signaling domain using a bispecific antibody targeting the molecule of the co-stimulatory signaling domain and a WBC antigen or a solid tumor antigen.
110. The method of embodiment 108, wherein the activating or enhancing functions or activities of the lymphocytes' co-stimulatory signaling domain comprising activating or enhancing functions or activities of the lymphocytes' co-stimulatory signaling domain using a CAR binding a WBC antigen.
111. The method of embodiment 108, wherein the activating or enhancing functions or activities of the lymphocytes' co-stimulatory signaling domain comprising activating or enhancing functions or activities of the lymphocytes' co-stimulatory signaling domain using a bispecific antibody targeting a solid tumor antigen/a WBC antigen and CD3 or comprising CD40L (or anti-CD40).
112. The method of any suitable preceding embodiments, further comprising: administering an effective amount of GCSF or GMCSF to the subject before administering the subject the effective amount of the population of lymphocytes.
113. The method of any suitable preceding embodiments, further comprising: administering an effective amount of GCSF or GMCSF to the subject after administering the subject the effective amount of the population of lymphocytes.
114. The method of any suitable preceding embodiments, further comprising: administering an effective amount of GCSF or GMCSF to the subject when administering the subject the effective amount of the population of lymphocytes.
115. An isolated nucleic acid sequence encoding a CAR, wherein the CAR comprises an extracellular domain, a transmembrane domain, and an intracellular domain, the extracellular domain binds an antigen, the intracellular signaling domain comprising an exogenous Signal Transducer and Activator of Transcription (STAT) 3 association motif, wherein the intracellular segment comprises an endogenous or exogenous JAK-binding motif and a STATS association motif, the intracellular signaling domain not comprising CD3zeta domain.
116. The isolated nucleic acid sequence of embodiment 115, wherein the exogenous JAK-binding motif can be inserted into an intracellular signaling domain, for example a cytoplasmic domain of an interleukin receptor chain.
117. The isolated nucleic acid sequence of embodiment 115, wherein the JAK-binding motif comprises a BOX-1 motif which allows for tyrosine kinase JAK association, for example JAK1, and the JAK-binding motif can be for example amino acid numbers 278 to 286 of NCBI RefSeq:NP_000869.1 (amino acids 13 to 21 SEQ ID NO: 360).
118. The isolated nucleic acid sequence of embodiment 115, wherein the domain comprises one region in a polypeptide, for example which is folded into a particular structure independently of other regions and/or has a particular function. The domain can for example be the cytoplasmic portion of a molecule or a part thereof.

119. The isolated nucleic acid sequence of embodiment 115, wherein the intracellular segment comprises an endogenous or exogenous JAK-binding motif and a STATS association motif" means in the case wherein the intracellular segment comprises more than one cytoplasmic domain, that the JAK binding motif and the STATS association motif may be in the same cytoplasmic domain or may be in separate cytoplasmic domains.

120. The isolated nucleic acid sequence of any of embodiment 115-119, wherein the exogenous STAT3 association motif is YXXQ (SEQ ID NO: 361).

121. The isolated nucleic acid sequence of any of embodiment 115-119, wherein the exogenous STAT3 association motif is YRHQ (SEQ ID NO: 362).

122. The isolated nucleic acid sequence of any of embodiment 115 to 121, wherein the exogenous STAT3 association motif is introduced less than 100 amino acid residues from the C terminus of the CAR.

123. The isolated nucleic acid sequence of any one of any one of embodiments 115 to 122, wherein the one or more intracellular signaling domains is or comprises the cytoplasmic domain of an interleukin receptor chain.

124. The isolated nucleic acid sequence of any one of any one of any one of embodiments 115 to 123, wherein the cytoplasmic domain of an interleukin receptor chain is a truncated fragment of said cytoplasmic domain comprising a JAK-binding motif and a STATS association motif.

125. The isolated nucleic acid sequence of any one of any one of any one of embodiments 115 to 124, wherein the STATS association motif is YXXL (SEQ ID NO: 363).

126. The isolated nucleic acid sequence of any one of embodiments 115-125, wherein the one or more intracellular signaling domains is or comprises a cytoplasmic co-stimulatory domain.

127. The isolated nucleic acid sequence of any one of embodiments 115 to 126, wherein the cytoplasmic co-stimulatory domain is a cytoplasmic domain of CD28, CD2, CD4, CD5, CD8a, CD8p, CD134 or CD137.

128. The isolated nucleic acid sequence of embodiment 127, wherein the cytoplasmic domain of an interleukin receptor chain is a truncated fragment of said cytoplasmic domain comprising a tyrosine kinase association motif and a STAT association motif.

129. The isolated nucleic acid sequence of any one of embodiments 115 to 128, wherein the interleukin receptor chain is selected from the group consisting of interleukin 2 receptor (IL-2R) beta chain and interleukin 21 receptor (IL-21 R) a chain.

130. The isolated nucleic acid sequence of any one of embodiments 115 to 129 wherein the extracellular domain is an antigen binding region of an antibody capable of binding to the predetermined antigen.

131. The isolated nucleic acid sequence of embodiment 130, wherein the antigen binding region of the antibody is a single chain variable fragment of said antibody.

132. The isolated nucleic acid sequence of any one of embodiments 115 to 131, wherein the transmembrane domain is selected from the group consisting of CD28 transmembrane domain and CD8 transmembrane domain.

133. The isolated nucleic acid sequence of any one of embodiments 115 to 131, wherein the nucleic acid encodes the CAR and further encodes a signal peptide at the N terminus.

134. A CAR of any one of embodiments 115 to 132.

135. A vector comprising the nucleic acid of any of embodiments 115-133.

136. A cell which expresses the CAR of any one of embodiments 1 to 18, and/or is transfected or transduced with the nucleic acid of any of embodiments 1-19 or the vector of embodiment 135.

137. A composition comprising the CAR, nucleic acid, vector or cell of any one of embodiments 115 to 136, and optionally a pharmaceutically acceptable excipient.

138. A method of making the cell of embodiment 20, further comprising transducing a cell with the nucleic acid of any of embodiments 115-1133 or the vector of embodiment 135.

139. A method of making the cell of embodiment 136, comprising: isolating immune cells from a mammal, optionally wherein the immune cells are T cells; transfecting or transducing the isolated immune cells, optionally T cells, with a nucleic acid encoding a CAR of any one of preceding embodiments; and optionally isolating and/or expanding the CAR-expressing cells, optionally CAR-expressing T cells following transfection or transduction.

140. Use of the CAR, nucleic acid, vector, cell or composition of any one of embodiments 115-139, for treating or preventing a disease and/or for decreasing in a subject the number of cells expressing a predetermined antigen.

141. A method of treating a disease in a subject, the method comprising administering to the subject in need thereof an effective amount of cells or the composition according to embodiments 139 or 140.

142. The use or method of embodiment 140 or 141 for providing an anti-tumor immunity in a mammal.

143. A method of decreasing in a subject the number of cells expressing a predetermined antigen, the method comprising administering to the subject in need thereof an effective amount of cells according to embodiment 134 or a composition comprising said cells that specifically bind to the predetermined antigen.

144. A method of enhancing T cell response, enhancing cellular therapy, and/or enhancing anti-tumor activities in a subject having cancer, the method comprising: administering an effective amount of a population of cells of embodiment 136 or 137; and allowing the T cells to expand and/or release a cytokine in body of the subject, wherein: the T cell response comprises T cell capabilities (e.g., expansion) and an amount of the cytokine released in the body of the subject, and the T cell response in the subject is enhanced as compared to T cells that include the CAR binding the solid tumor but don't comprise the CAR binding the WBC antigen or the tag.

145. The method of embodiment 144, wherein the T cell capabilities (e.g., expansion) is measured based on an increase in copy number of CAR molecules in genomic DNA of the T cells.

146. The method of embodiment 144, wherein the amount of the cytokine is enhanced as compared to T cells that include the CAR binding the solid tumor but don't comprise the CAR binding the WBC antigen or the tag.

147. The method of embodiment 146, wherein the cytokine is IL-6 or IFN-γ.

148. Any suitable preceding embodiments, wherein the modified cells or cells are lymphocytes such as T cells, NK cells, macrophages, DCs.
149. The method of any suitable preceding embodiments, further comprising: administering an effective amount of GCSF or GMCSF to the subject before, after, or when administering the subject the effective amount of the population of lymphocytes.
150. A method of in vivo cell capabilities (e.g., expansion), the method comprising:
administering an effective amount of cells comprising an antigen binding molecule to a subject; and
administering an effective amount of presenting agents (e.g., presenting cells) expressing a solid tumor antigen that the binding molecule recognizes.
151. A method of preparing cells in vitro, the method comprising:
providing a first population of modified cells comprising a CAR binding a WBC antigen and a second population of modified cells comprising an antigen binding molecule; and
culturing the first population and the second population T cells in the present of a cell that the CAR binds.
152. The method of embodiment 151, further comprising: allowing the second population to expand, wherein the capabilities (e.g., expansion) of the second population of modified cells is greater than a population of modified cells without including the first population of modified cells or without culturing in the present of the cell.
153. The method of embodiment 151, further comprising: allowing the second population to release a cytokine, wherein the cytokine release of the second population of modified cells is greater than a population of modified cells without including the first population of modified cells or without culturing in the present of the WBC.
154. The method of embodiment 151, wherein the phenotypes of memory T cells of the second population of modified cells are greater than a population of modified cells without including the first population of modified cells or without culturing in the present of the WBC.
155. A B cell comprising a polynucleotide encoding a solid tumor antigen.
156. A B cell comprising a solid tumor antigen, wherein the solid tumor antigen is associated with the membrane of the B cell and/or the B cell comprise a therapeutic agent.
157. The composition or method of any preceding suitable embodiments, wherein the presenting cells comprise a PBMC cell.
158. The composition or method of any preceding suitable embodiments, wherein the presenting cells comprise an antigen-presenting cell.
159. The composition or method of any preceding suitable embodiments, wherein the presenting cells comprise a T cell, a B cell, a DC, and/or a macrophage.
160. The composition or method of any preceding suitable embodiments, wherein the presenting cells comprise a polynucleotide encoding the solid tumor antigen.
161. The method of any preceding suitable embodiments, further comprising: preferentially delivering the solid tumor antigen to the cytosol of an immune cell, which may be implemented by passing a cell suspension comprising said immune cell through a microfluidic device and contacting said cell suspension with said compound, wherein said microfluidic device comprises a constriction having a diameter of 2 μm to 10 μm. More information about the delivery can be found at US Patent Publication NO: US20180142198, which is incorporated herein by its reference.
162. The composition or method of any preceding suitable embodiments, wherein the presenting cells comprise a polynucleotide encoding a co-stimulatory domain.
163. The composition or method of any preceding suitable embodiments, wherein the presenting cells comprise a polynucleotide encoding a therapeutic agent.
15. The composition or method of any preceding suitable embodiments, wherein therapeutic agent comprises a cytokine (e.g., IL-6, IL-12, IFNγ etc.).
164. The composition or method of any preceding suitable embodiments, wherein the therapeutic agent is associated with the membrane of the presenting cells.
17. The composition or method of any preceding suitable embodiments, wherein the presenting cells comprise a polynucleotide encoding a suicide gene (e.g., RQR8).
18. The composition or method of any preceding suitable embodiments, wherein the expression of the polynucleotide is regulated by a dependent expression system (e.g., DOX).
165. The composition or method of any preceding suitable embodiments, wherein the solid tumor antigen comprises an antigen of a non-essential tissue cell.
166. The composition or method of any preceding suitable embodiments, wherein the solid tumor antigen comprises an HLA-restricted peptide antigen.
167. The composition or method of any preceding suitable embodiments, wherein the solid tumor antigen is in a soluble form that is released by the presenting cells.
168. The composition or method of any preceding suitable embodiments, wherein the solid tumor antigen is expressed by the presenting cells and associated with the membrane of the presenting cells.
169. The composition or method of any preceding suitable embodiments, wherein capabilities (e.g., expansion) of the second population of cells in the subject is greater than capabilities (e.g., expansion) of the second population of cells in a subject that is administered with the second population of cells but not the first the population of cells.
170. The composition or method of any preceding suitable embodiments, wherein the expansion is measured based on numbers of second population of cells or copy numbers of DNA encoding the second CAR.
171. The composition or method of any preceding suitable embodiments, wherein the cells are T cells, NK cells, macrophages, or dendritic cells.
172. The composition or method of any preceding suitable embodiments, wherein the first antigen comprises a cell surface molecule of a white blood cell (WBC), a tumor antigen, or a solid tumor antigen.
173. The composition or method of any preceding suitable embodiments, wherein the WBC is a granulocyte, a monocyte, or a lymphocyte.
174. The composition or method of any preceding suitable embodiments, wherein the WBC is a B cell.
175. The composition or method of any preceding suitable embodiments, wherein the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13.
176. The composition or method of any preceding suitable embodiments, wherein the cell surface molecule of the WBC is CD19, CD20, CD22, or BCMA.

177. The composition or method of any preceding suitable embodiments, wherein the cell surface molecule of the WBC is CD19 or BCMA.
178. The composition or method of any preceding suitable embodiments, wherein the tumor antigen is a solid tumor antigen.
179. The composition or method of any preceding suitable embodiments, wherein the solid tumor antigen is tumor associated MUC1 (tMUC1), PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, CLDN18.2, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, B7-H3, or EGFR.
180. The composition or method of any preceding suitable embodiments, wherein the solid tumor antigen comprises tMUC1, ACPP, TSHR, GUCY2C, UPK2, CLDN18.2, PSMA, DPEP3, CXCR5, B7-H3, MUC16, SIGLEC-15, CLDN6, Muc17, PRLR, or FZD10.
181. The composition or method of any preceding suitable embodiments, wherein the solid tumor antigen comprises tMUC1, ACPP, TSHR, GUCY2C, UPK2, or CLDN18.2.
182. The composition or method of any preceding suitable embodiments, wherein the CAR comprises an antigen binding domain, a transmembrane domain, a co-stimulatory domain, and a CD3 zeta domain.
183. The composition or method of any preceding suitable embodiments, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that binds CD83, or a combination thereof.
184. The composition or method of any preceding suitable embodiments, wherein the first CAR comprises a scFv binding CD19, an intracellular domain of 4-1BB or CD28, and CD3 zeta domain, and the second CAR comprises a scFv binding tMUC1, ACPP, TSHR, GUCY2C, or CLDN18.2., an intracellular domain of 4-1BB or CD28, and CD3 zeta domain.
185. The composition or method of any preceding suitable embodiments, wherein an antigen binding domain of the first CAR comprises SEQ ID NO: 5 and an antigen binding domain of the second CAR comprises SEQ ID NO: 66.
186. The composition or method of any preceding suitable embodiments, wherein the second population of cells comprises a lentiviral vector encoding the second CAR and a dominant negative form of PD-1.
187. The composition or method of any preceding suitable embodiments, wherein the first population of cells comprises a lentiviral vector encoding the first CAR and a therapeutic agent.
188. The composition or method of any preceding suitable embodiments, wherein the therapeutic agent comprises a cytokine.
189. The composition or method of any preceding suitable embodiments, wherein the cytokine is IL6 and/or INFγ.
190. The composition or method of any preceding suitable embodiments, wherein the cytokine is at least one of IL6, IL12, IL-15, IL-7, TNF-α, or IFN-γ.
191. A method of enhancing capabilities (e.g., expansion) of cells, the method comprising: providing a pharmaceutical agent associated with T or NK cells, the agent comprising an antibody binding a white blood cell (WBC) antigen; providing a population of cells comprising an antigen binding molecule targeting a solid tumor antigen; contacting the pharmaceutical agent and the population of cells comprising the antigen binding molecule with an agent comprising the WBC antigen; and allowing the population of cells to expand, wherein capabilities (e.g., expansion) of the population of cells is greater than a population of cells that are contacted with the agent comprising the WBC antigen but not with the pharmaceutical agent.
192. The method of embodiment 191, wherein the pharmaceutical agent associated with T cells or NK cells comprise a scFv binding the WBC antigen and a scFv binding CD3.
193. The method of embodiment 191, wherein the pharmaceutical agent associated with T cells or NK cells comprises a T cell or a NK cell comprising a CAR binding WBC antigen.
194. The method of embodiment 191, further comprising: allowing the second population of cells to release a cytokine, wherein cytokine release of the population of cells in the mixed cells is greater than a population of cells that are contacted with the agent comprising the WBC antigen but not with the pharmaceutical agent.
195. The method of embodiment 191, wherein the agent comprises a cell comprising the WBC antigen or a bead linked to the WBC antigen, or a combination thereof.
196. The method of embodiment 191, wherein the WBC antigen is CD19, CD22, CD20, BCMA, CD5, CD7, CD2, CD16, CD56, CD30, CD14, CD68, CD11b, CD18, CD169, CD1c, CD33, CD38, CD138, or CD13.
197. The method of embodiment 191, wherein the second population of cells in the mixed cells comprise more phenotypes of memory T cells than a second population of cells in mixed that do not include the first population of cells.
198. The method of embodiment 191, wherein the antigen binding molecule is a CAR or a TCR, or a combination thereof, and wherein the CAR comprises an antigen binding domain, a transmembrane domain, a co-stimulatory domain, and a CD3 zeta domain.
199. The method of embodiment 191, wherein the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIll, B7-H3, MAGE A4, or EGFR.
200. The method of embodiment 198, wherein the co-stimulatory domain comprises an intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that binds CD83, or a combination thereof.
201. The method of embodiment 191, wherein the first population of cells or the second population of cells, or a combination thereof, comprises IL6 or IFN-γ, or a combination thereof.

202. The method of embodiment 191, wherein the first population of cells or the second population of cells, or a combination thereof, comprises a lentiviral vector encoding a therapeutic agent.
203. The method of embodiment 202, wherein the therapeutic agent comprises a cytokine.
204. The method of embodiment 203, wherein the cytokine is at least one of IL6, IL12, TNF-α, or IFN-γ.
205. The method of embodiment 191, wherein the antigen binding molecule is a TCR.
206. The method of embodiment 191, wherein the antigen binding molecule is a modified TCR.
207. The method of embodiment 205, wherein the TCR is derived from spontaneously occurring tumor-specific T cells in patients.
208. The method of embodiment 205, wherein the solid tumor antigen comprises CEA, gp100, MART-1, p53, MAGE-A3, or NY-ESO-1.
209. The method of embodiment 205, wherein the TCR comprises TCRγ and TCRδ Chains or TCRα and TCRβ chains, or a combination thereof.
210. The method of embodiment 191, wherein the first population of cells or the second population of cells, or a combination thereof, comprises a dominant-negative PD-1 form.
211. A method of enhancing capabilities (e.g., expansion) of cells, the method comprising: providing mixed cells comprising a first population of cells comprising a Chimeric Antigen Receptor (CAR) binding a white blood cell (WBC) antigen and a second population of cells comprising an antigen binding molecule targeting a solid tumor antigen; contacting the mixed cells with cells comprising the WBC antigen; and allowing the second population of cells to expand, wherein capabilities (e.g., expansion) of the second population of cells in the mixed cells is greater than a second population of cells in mixed cells that do not include the first population of cells.
212. The method of embodiment 211, further comprising: allowing the second population of cells to release a cytokine, wherein cytokine release of the second population of cells in the mixed cells is greater than a second population of cells in mixed cells that do not include the first population of cells.
213. The method of embodiment 211, wherein the first population of cells and the second population of cells comprise NK or T cells, or a combination thereof.
214. The method of embodiment 211, wherein the cells comprise B cells or PBMCs, and/or the CAR binding the white blood cell does not comprise functional CD3 zeta such that the CAR does not cause cell lysis of the B cell.
215. The method of embodiment 211, wherein the antigen binding molecule is a CAR or a TCR, or a combination thereof.
216. The method of embodiment 211, wherein the WBC antigen is CD19, CD22, CD20, BCMA, CD5, CD7, CD2, CD16, CD56, CD30, CD14, CD68, CD11b, CD18, CD169, CD1c, CD33, CD38, CD138, or CD13.
217. The method of embodiment 211, wherein the second population of cells in the mixed cells comprise more phenotypes of memory T cells than a second population of cells in mixed that do not include the first population of cells.
218. The method of embodiment 211, wherein the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, B7-H3, MAGE A4, or EGFR.

219. The method of embodiment 211, wherein the CAR comprises an antigen binding domain, a transmembrane domain, a co-stimulatory domain, and a CD3 zeta domain.
220. The method of embodiment 219, wherein the co-stimulatory domain comprises an intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that binds CD83, or a combination thereof.
221. The method of embodiment 211, wherein the first population of cells or the second population of cells, or a combination thereof, comprises IL6 or IFN-γ, or a combination thereof.
222. The method of embodiment 211, wherein the first population of cells or the second population of cells, or a combination thereof, comprises a lentiviral vector encoding a therapeutic agent.
223. The method of embodiment 222, wherein the therapeutic agent comprises a cytokine.
224. The method of embodiment 223, wherein the cytokine is at least one of IL6, IL12, TNF-α, or IFN-γ.
225. The method of embodiment 211, wherein the antigen binding molecule is a TCR.
226. The method of embodiment 211, wherein the antigen binding molecule is a modified TCR.
227. The method of embodiment 225, wherein the TCR is derived from spontaneously occurring tumor-specific T cells in patients.
228. The method of embodiment 225, wherein the solid tumor antigen comprises CEA, gp100, MART-1, p53, MAGE-A3, or NY-ESO-1.
229. The method of embodiment 225, wherein the TCR comprises TCRγ and TCRδ Chains or TCRα and TCRβ chains, or a combination thereof.
230. The method of embodiment 211, wherein the first population of cells or the second population of cells, or a combination thereof, comprises a dominant-negative PD-1 form.
231. A method of activating and/or expanding T lymphocytes, the method comprising: providing a first multiple-specific antibodies comprising an antigen binding domain binding a WBC antigen and an antigen binding domain binding a T cell antigen; providing a second multiple-specific antibodies comprising an antigen domain binding a tumor antigen and an antigen binding domain binding a T cell antigen; and contacting APCs and the T lymphocytes with the first multiple-specific antibodies and the second multiple-specific antibodies; and allowing the lymphocytes to be activated and/or expanded.
232. A method of activating and/or expanding cells, the method comprising: providing a mixed population of cells comprising lymphocytes and antigen-presenting cells (APCs); contacting the mixed population of cells with an agent that stimulates or activates the APCs; and allowing the lymphocytes to be activated and/or expanded.

232. A composition comprising the first multiple-specific antibodies and the second multiple-specific antibodies of embodiment 231 or 232, wherein an amount of the first multiple-specific antibodies is less than the second multiple-specific antibodies.

233. The method of embodiment 231 or 232, wherein the expansion of the lymphocytes is enhanced as compared to the lymphocytes contacted with the second multiple-specific antibodies without the first multiple-specific antibodies.

234. The method of embodiment 231 or 232, wherein the APCs comprise at least one or more of dendritic cells, macrophages, Langerhans cells and B cells, or T cells.

235. The method of embodiment 231 or 232, wherein the APCs comprise B cells.

236. The method of embodiment 231 or 232, wherein the lymphocytes comprise T cells or NK cells, or a combination thereof.

237. The method of embodiment 231 or 232, wherein the WBC antigen is a B cell antigen.

238. The method of embodiment 231 or 232, wherein the WBC antigen comprises at least one or more of CD19, CD20, CD22, CD53, CD138, BCMA, CD38, or FCRL5.

239. The method of embodiment 231 or 232, wherein the lymphocytes comprise T cells and/or NK cells.

240. The method of embodiment 231 or 232, wherein the tumor antigen is selected from a group consisting of: MUC1 (tMUC1), PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, CLDN 18.2, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα 2, Mesothelin, PSMA, ROR1, VEGFR-II, GD2, FR-α, ErbB2, EpCAM, EGFRvIll, MAGE A4, EGFR, and a combination thereof.

241. The method of embodiment 231 or 232, wherein the first multiple-specific antibodies are bispecific antibodies binding CD3 and CD19.

242. The method of any one of the preceding embodiments, wherein the second multiple-specific antibodies comprises bispecific antibodies binding CD3 and a solid tumor antigen.

243. The method of any one of the preceding embodiments, wherein the first and/or second multiple-specific antibodies comprise an agonist or a ligand of a co-stimulation molecule.

244. The method of embodiment 243, wherein the co-stimulation molecule comprises one or more of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CDS, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKp44, NKp30, NKp46, NKG2D, or a combination thereof.

245. The method of embodiment 232, wherein the APCs comprise B cells.

246. The method of embodiment 232, wherein allowing the population of lymphocytes to be activated and/or expanded comprises allowing the population of lymphocytes to be and/or expanded without contacting an antigen that the lymphocytes bind.

247. The method of embodiment 232, wherein the agent comprises at least one or more of a CAR T cell binding a B cell, a bispecific antibody binding a B cell and a T cell, a cytokine capable of differentiate a B cell into a plasma cell, or an antibody binding a B cell.

248. The method of embodiment 232, wherein the agent comprises an antibody binding a B cell.

249. The method of embodiment 232, wherein the agent comprises a scFv binding a B cell.

250. The method of embodiment 232, wherein the lymphocytes comprise T cells, NK cells, or a combination thereof.

251 The method of embodiment 232, wherein the agent binds a B cell antigen.

252. The method of embodiment 251, wherein the B cell antigen comprises at least one or more of CD19, CD20, CD22, CD53, CD138, BCMA, CD38, or FCRL5.

253. The method of embodiment 232, wherein the APCs comprise B cells, and the stimulating or activating the APCs comprise stimulating or activating the B cells to up-regulate at least one or more of CD40, CD80, or CD86 on the B cells.

254. The method of embodiment 232, wherein the APCs comprise B cells, and the stimulating or activating the APCs comprises causing or inducing the B cells to differentiate into B cells with up-regulated CCL17 and CCL22.

255. The method of any one of embodiments 231-254, wherein the population of lymphocytes comprises a CAR or TCR.

EXAMPLES

CoupledCAR° and Cell Expansion

Mixed CAR T cells (CoupledCAR® T cells) were divided into three Groups for assays related to activation: CD19 CAR and tMUC1 CAR (Group 1), CD19 CAR and ACPP CAR (Group 2), and CD19 and CLDN18.2 CAR (Group 3). Peripheral blood of healthy volunteers was collected. CD3+ T cells were sorted using Pan T kits, and CD3/CD28 Dynabeads were added at a 1:1 ratio. CD3+ T cells were then transfected with lentivirus. The lentivirus and the Dynabeads were removed, and fresh media were added. CAR ratios and cell phenotype were determined. Expression of CAR in these three groups of cells was measured. CD19 CAR T cells, tMUC1 CAR T cells, and target cells were selected and mixed for 24 hours or 48 hours. Expression of various markers in corresponding cells was measured. $20\times10^4$ CAR T cells and $20\times10^4$ substrate cells were co-cultured for 24 hrs. The expression of molecules such as hCAR (humanized scFv), mCAR (murine scFv), CD25, and CD137 in T cells was measured by flow cytometry. For example, CD25 and CD137 positive staining indicated that T cells were activated. Amounts of cytokines released from various T cells were measured in response to the antigen activation, and background of the corresponding T cells was subtracted.

Tables 11, 12, and 13 provide information for CAR T cells and corresponding substrate cells of Group 1, Group 2, and Group 3, respectively. For example, CAR 1204 is a human-derived CAR, which can be labeled with human CAR antibody and CD137 antibody. CAR 2407 (tMUC1 CAR) is a murine CAR that can be labeled for activation with a murine CAR antibody and a CD137 antibody. Cells expressing CAR 1204 (CD19 CART cells) can be activated by K562 cells expressing CD19, resulting in up-regulated CD137 expression. CAR 1204 cells, CAR 2407 cells, and K562 cells expressing CD19 were co-cultured to induce CD19 CART cell activation. The binding domains of CD19 CAR and tMUC1 CAR include SEQ ID NOs: 5 and 66, respectively. The activation of 2407 CAR T cells was detected and measured based on the expression of CD137, which evidence the indirect activation of CD19 CAR T cells.

TABLE 4

| CAR T cells and substrate cells used in Group 1 | | | |
|---|---|---|---|
| Coupled CAR T Cells | CD19 CAR T Cells & tMUC1 CAR T Cells | | |
| CAR T cell ID | CAR | Substrate cell ID | Notes |
| 1234 | CD19 CAR | K19 | CD19 positive Cell |
| 2407 | tMUC1 CAR | MCF-17 | 5E5 (tMUC1) positive cell |

FIG. 1 shows results of flow cytometry analysis of CD19 CART cells co-cultured with tMUC1 CART cells in the presence or absence of K19 cells.

Peripheral blood of healthy volunteers was collected on day 0. CD3+ T cells were sorted using Pan T kits, and CD3/CD28 Dynabeads were added to the collected CD3+ T cells at a 1:1 ratio. On day 1, the activated CD3+ T cells were divided into two subgroups, each transfected with lentivirus encoding a single CAR (CD19 CAR or tMUC1 CAR). Thus, two subgroups of CAR T cells were obtained: a subgroup of CAR T cells expressing CD19 CAR, and another subgroup of CAR T cells expressing tMUC1 CAR. The binding domains of CD19 CAR and tMUC1 CAR include SEQ ID NOs: 5 and 66, respectively. On day 2, the lentivirus and the Dynabeads were removed, and fresh media were added. On day 7, CAR T cells and target cells were co-cultured for 24 hours, and various assays were performed on day 8. Subgroups of cells can be mixed and co-cultured with corresponding substrate cells (see FIGS. 36-60).

FIG. 1 provides histograms showing CD137 expression in various cell cultures. In each cell culture, CART cells were cultured with the corresponding substrate cells, and CD137 expression was measured using flow cytometry (Gate mCAR+: tMUC1 CAR). The cell cultures include (1) tMUC1 CAR T cells and K19, (2) tMUC1 CART cells, K19, and PBMC, (3) tMUC1 CART cells, CD19 CART cells and K19, (4) tMUC1 CAR CART cells, CD19 CART cells, K19, and PBMC. The CD8+ T cells were also counted. As shown in FIG. 1, the activation of tMUC1 CART cells (i.e., expression of CD137) was observed in the presence of K19, and the activation level of MUC1 CAR T cells was higher than that of the single group. Further, the level of activation was higher after adding PBMC (e.g., MFI of CD137). These results indicate that the activation of CD19 CAR T cells by K19 activates tMUC1 CAR T cells in the absence of the antigen that tMUC1 CAR binds (tMUC1), and this activation is enhanced by the presence of PBMC. The experimental results are based on the expression ratio as the main basis for measuring the difference (left). When the proportional difference is not significant, the expression intensity (MFI) is used as a measure of the difference (right).

Figure 2:
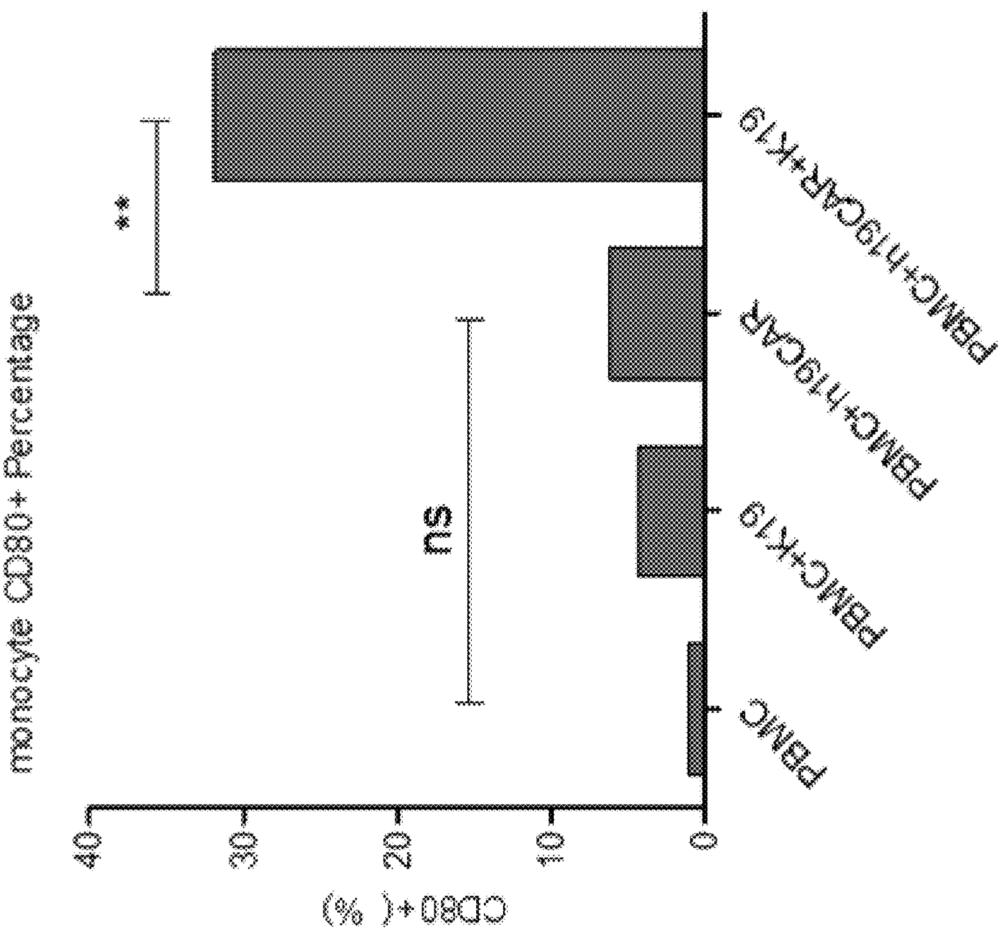
FIG. 2 shows the activation of PBMC and monocytes in the cell cultures used in the assay of FIG. 1.

FIG. 2 shows the activation of PBMC and monocytes in the cell cultures described in FIG. 1. Flow cytometry assays of monocyte (CD14+) and activated monocyte (CD14+ CD80+) were performed in PBMC, and FIG. 2 shows a histogram of statistical analysis of the assays. h19CAR is a humanized CD19 CAR, and the cell cultures include (1) PBMC alone, (2) PBMC+K19, (3) PBMC and CD19 CART cells, (4) PBMC, K19, and CD19 CART cells. As shown in FIG. 2, the last group of PBMCs showed activation (CD80 expression). These results show that activation of the CAR T cells is capable of activating PBMC including monocytes. Combination of the results shown in FIGS. 1 and 2 indicates that activation of CD19 CAR T cells by K19 activates tMUC1 CAR T cells in the absence of the antigen that tMUC1 CAR binds, and this activation can be mediated at least partially through PBMC.

Figure 3:
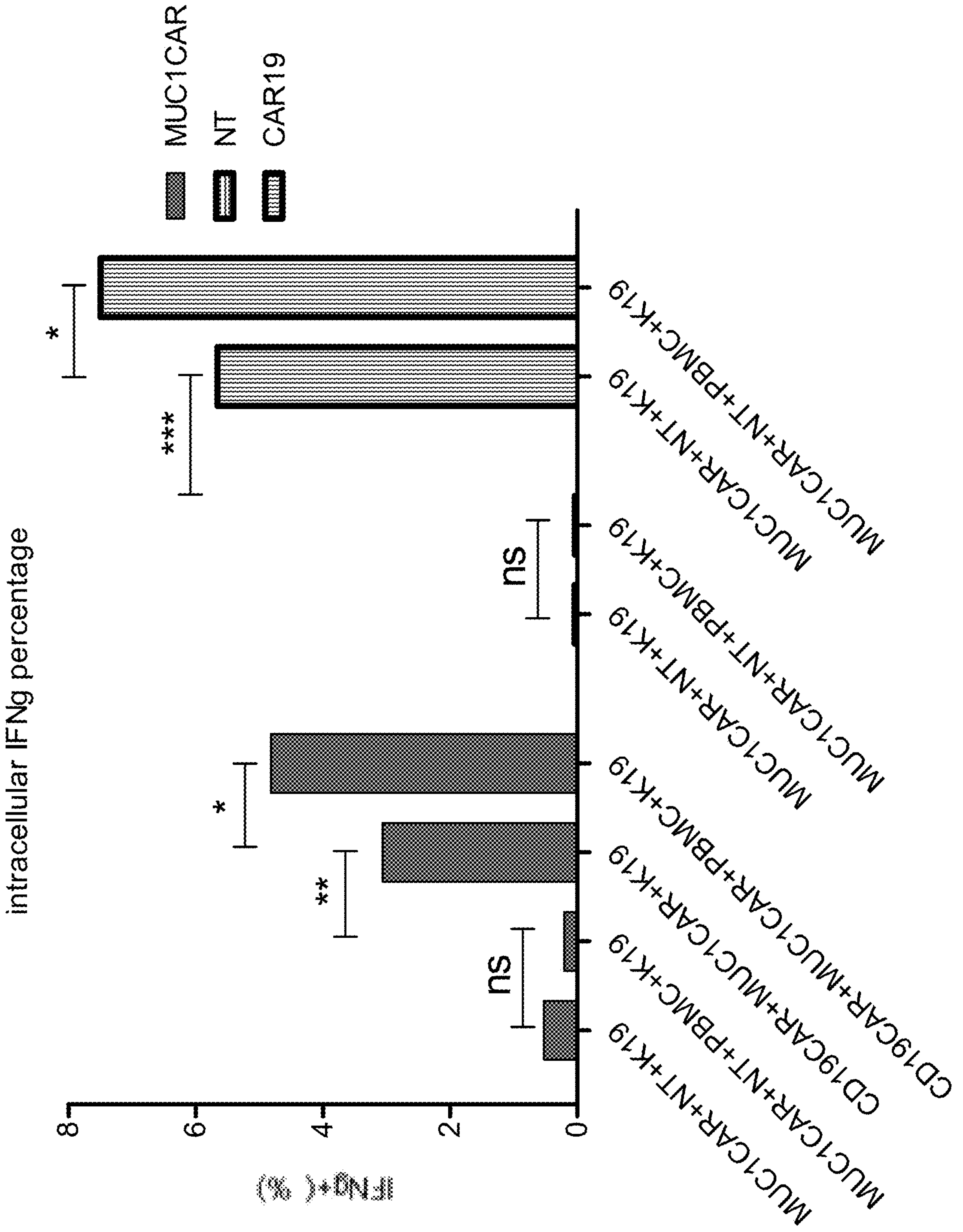
FIG. 3 shows IFNγ (IFNg of IFN-γ) release by tMUC1 CAR T cells and CD19 CAR T cells.

FIG. 3 provides a histogram showing IFNγ release by tMUC1 CART cells and CD19 CAR T cells. Various cells were cultured on day 7, and flow cytometry assays were performed on day 8. The graph is a statistical analysis of the convective graph. In these assays, NT (non-transfected T cells) was used as a control. Compared with the control, cell cultures including CD19 CART cells and tMUC1 CART cells showed an increase of intracellular IFNγ in CD19 CART and MUC1 CART cells, indicating that CD19 CART cells activated by K19 released IFNγ and activated tMUC1 CAR T cells to release IFNγ. The PBMC group up-regulated the ratio of IFNγ released by CD19 CART cells and by tMUC1 CART cells. IFNγ cumulated in the coupled CAR group was more than that in the cells expressing a single CAR (CD19 CAR or tMUC1 CAR), and the addition of PBMC upregulated this effect. The mCAR-group is not all CD19 CAR positive cells, and the statistical value is relative. The results show that activation of CD19 CART cells induced tMUC1 CAR T cells to express more IFNγ and thus release IFNγ in the absence of the antigen that tMUC1 CAR binds (tMUC1).

Figure 4:
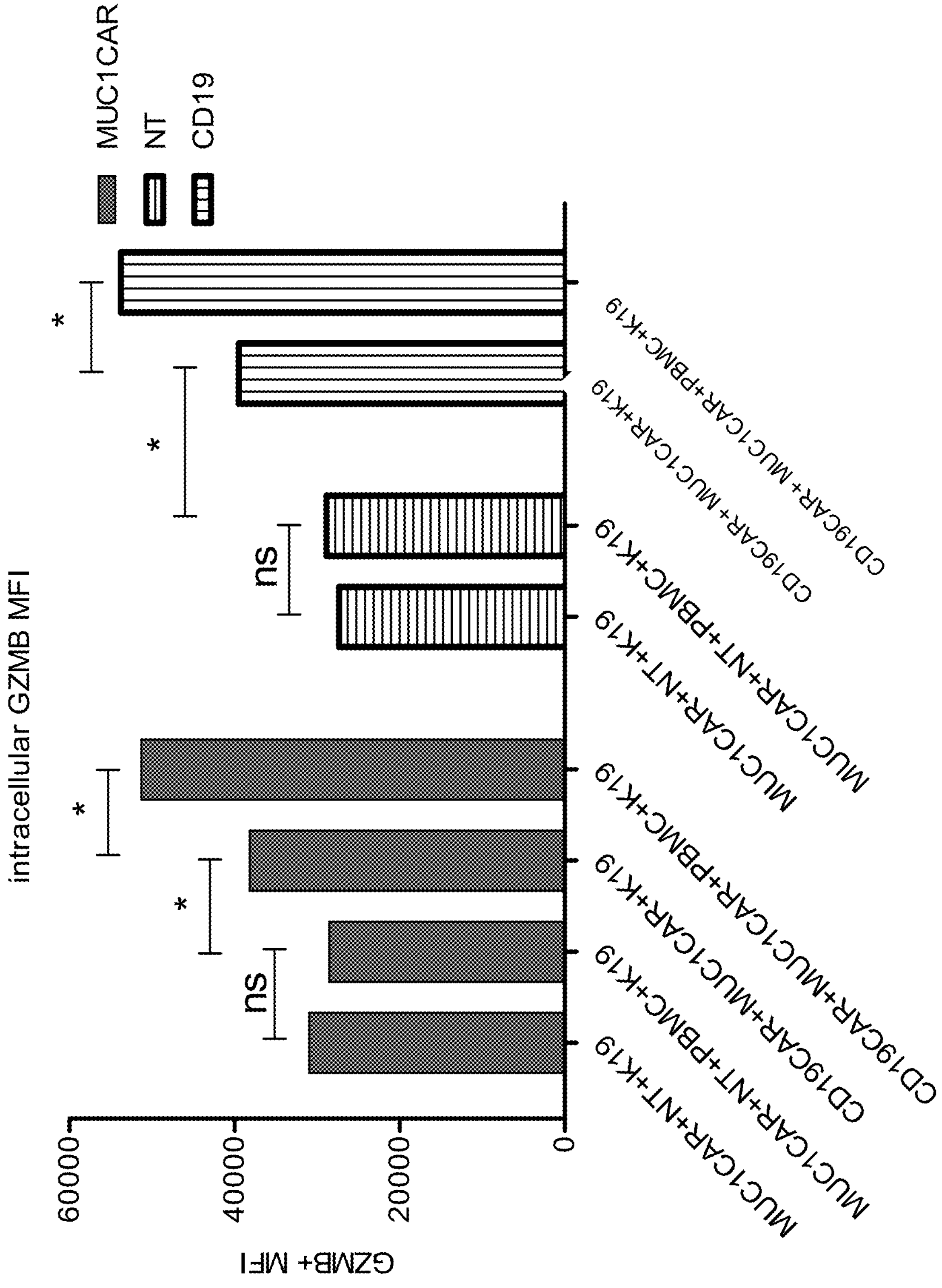
FIG. 4 shows GZMB release by tMUC1 CART cells and CD19 CART cells.

FIG. 4 provides a histogram showing GZMB release by tMUC1 CAR T cells and CD19 CART cells. Various cells were cultured on day 7, and flow cytometry assays were performed on day 8. Flow cytometry assays showed GZMB release by the activated CD19 CAR T cells and MUC1 CAR T cells. The statistical analysis of the convective graphs (proportional comparison MFI) indicates that the activation of CD19 CAR T cells can cause MUC1 CAR T cells to release GZMB, and such release was enhanced in the presence of PBMC. The mCAR-group is not all CD19 CAR positive cells, and the statistical value is relative. These results show that activation of CD19 CAR T cells induced MUC1 CAR T cells to release intracellular GZMB.

Figure 5:
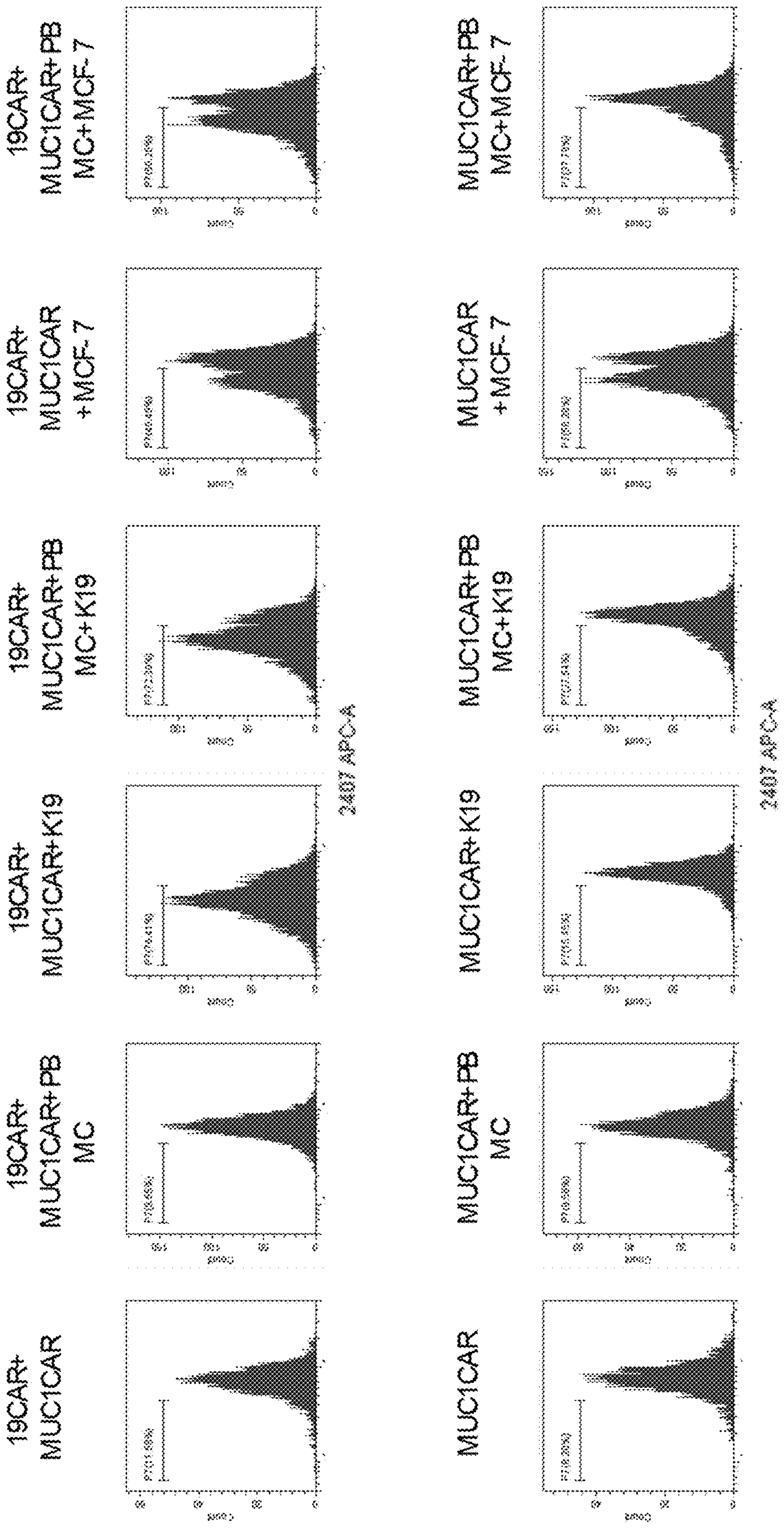
FIGS. 5 and 6 show proliferation of MUC1 (tMUC1) CAR T cells in various embodiments.
Figure 6:
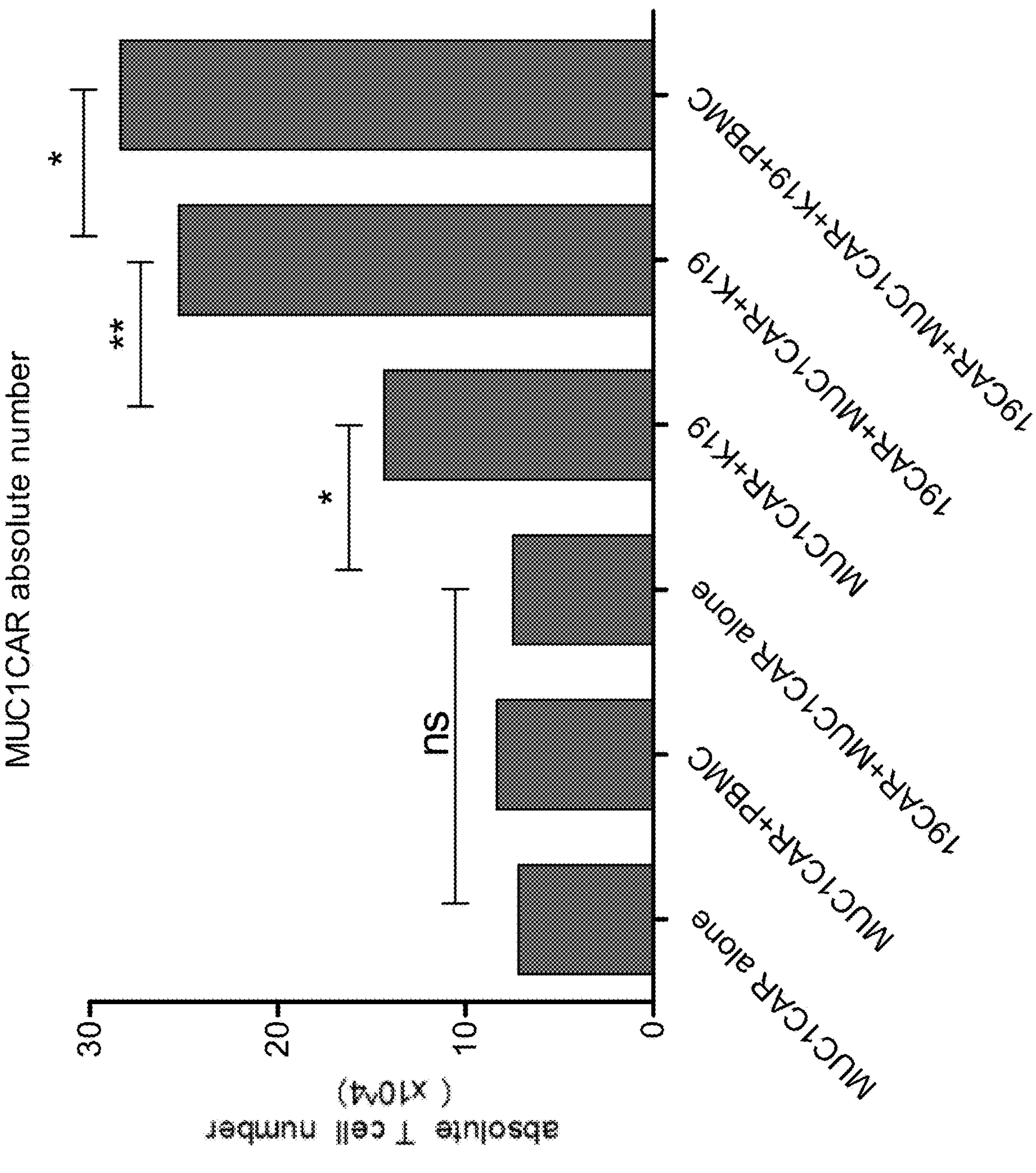

FIGS. 5 and 6 show proliferation of MUC1 CAR T cells in various embodiments. CFSE reactions were performed and used to indicate levels of cell proliferation. Various cells were cultured on day 7, and flow cytometry assays were performed on day 8. As shown on FIG. 5, the first row is the experimental group of coupled CAR T cells co-cultured with two substrate cells, and the second row is the control group of MUC1 CAR T cells co-cultured with two substrate cells. As shown in the third and fourth columns of the first and second rows, activation of CD19 CAR T cells with K19 induces the proliferation of MUC1 CAR T cells. The fifth and sixth columns show that MCF-7 activates and incudes the proliferation of MUC1 CAR T cells. FIG. 6 shows counting results from the flow cytometry shown in FIG. 5. The volume calibration was performed, tMUC1 CAR cell population was gated, and the number of cells of each group of tMUC1 CAR was statistically analyzed. As shown in FIG. 6, the number of cells in the group including CD19 CAR T cells and tMUC1 CAR T cells was higher than that in the control group, and the proliferation of the group including CD19 CART cells and tMUC1 CART cells in the presence of PBMC was the highest. The results show that activation of CD19 CAR T cells can enhance the proliferation of MUC1 CAR T cells, which can be enhanced and/or medicated through PBMC.

Figure 7:
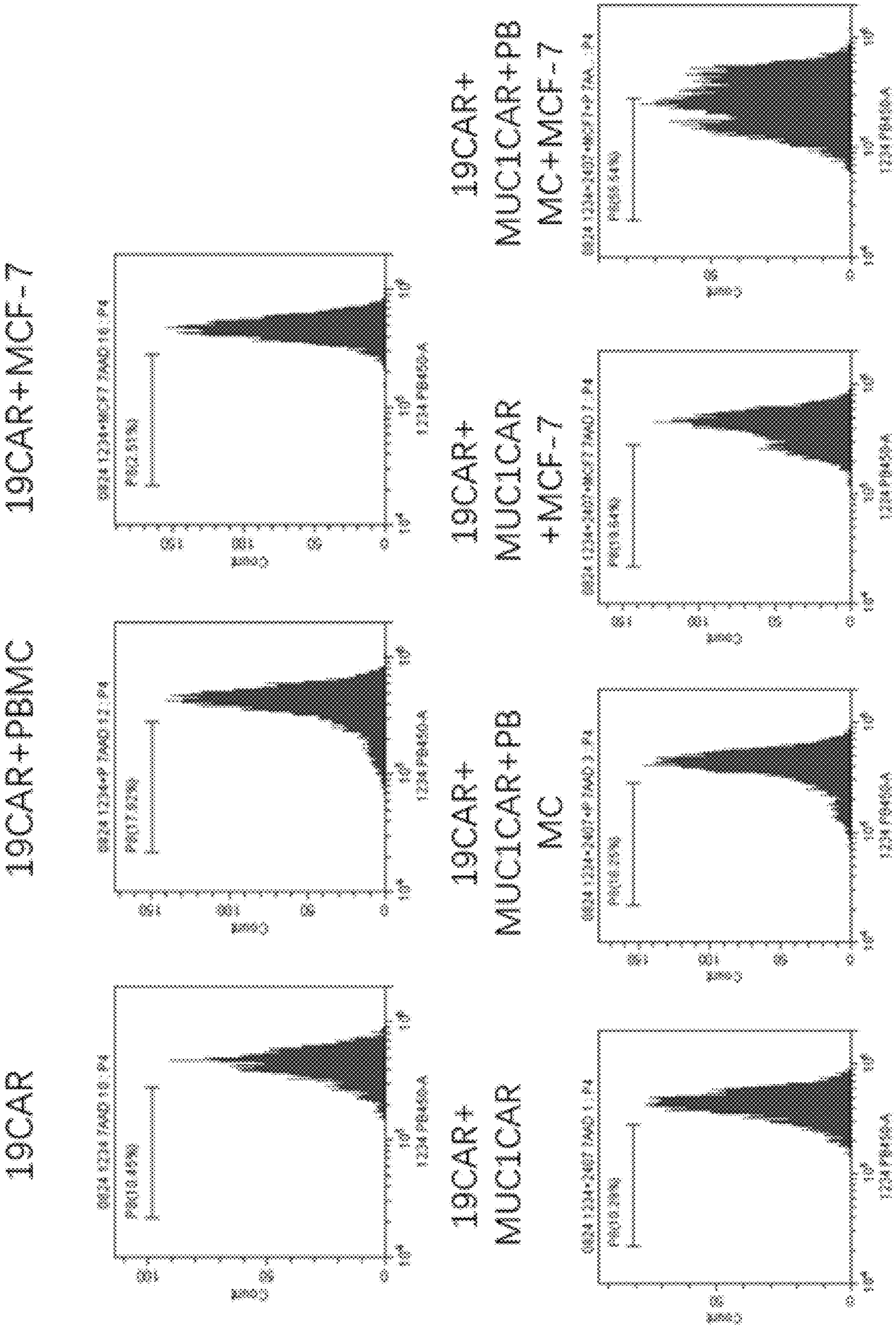
FIG. 7 shows proliferation of CD19 CART cells in various embodiments.

FIG. 7 shows the proliferation CD19 CAR T cells in various embodiments. CFSE reactions were performed and used to indicate levels of cell proliferation. Various cells were cultured on day 7, and flow cytometry assays were performed on day 8. The groups of cells comprising CD19 CART cells, tMUC1 CART cells, MCF-7 in the presence or absence of PBMC showed the proliferation of CD19 CAR T cells. These results show that activation of tMUC1 CAR T cells can enhance the proliferation of CD19 CAR T cells, which may be enhanced and/or medicated through PBMC. The combination of the results shown in FIGS. 5-7 indicates that the mixture of CD19 CART cells and tMUC1 CART cells may form a positive circle through PBMC such that activation of CD19 CAR T cells or tMUC1 CAR T cells may further activate each other to enhance the proliferation of CD19 CAR T cells and tMUC1 CAR T cells and/or the release of cytokines by CD19 CAR T cells and tMUC1 CAR T cells, which may be mediated and/or enhanced by PBMC. These results can also explain the reason that tMUC1 CAR T cells expanded more in subjects infused with a population of cells comprising coupled CART cells (e.g., Patients 001-003) than subjects infused with a population of cells including a single type of CAR T cells. Coupled CAR T cells (e.g., CD19 CAR T cells and tMUC1 CAR T cells) can contribute to this enhanced cell expansion.

Figure 8:
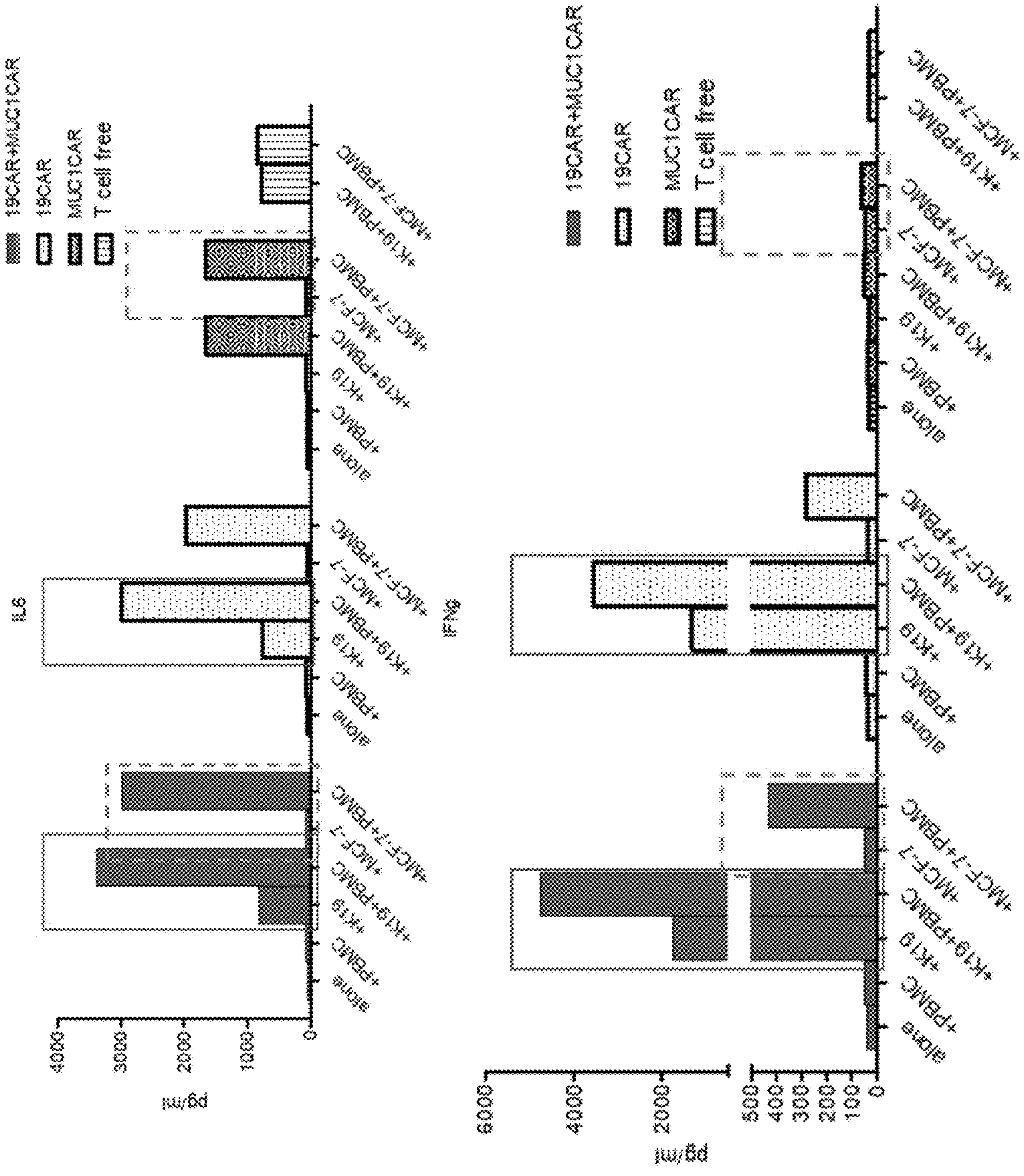
FIG. 8 shows cytokine release in various embodiments.

FIG. 8 shows cytokine release in embodiments. Various cells were cultured on day 7, and flow cytometry assays were performed on day 8. As shown in FIG. 8, IFN-γ release in the control group is limited. The coupled CAR group and single CAR group are labeled using the solid line and the dotted line, respectively. The levels of IFN-γ released were similar in the absence of PBMC. When PBMC was added, the levels of IFN-γ released increased. IL6 was mainly secreted by PBMC, and the released amount in the activated system is increased. Here, the amount of tMUC1 CAR cytokine released was relatively low.

TABLE 5

| CAR T cells and substrate cells used in Group 2 | | | |
|---|---|---|---|
| Coupled CAR T cells | CD19 CAR T cells & ACPP CAR cells | | |
| CAR T Cell ID | CAR | Substrate Cell | Notes |
| 1234 | CD19 CAR | Nalm | CD19 positive Cell |
| 6503 | ACPP CAR | PC3-ACPP | ACPP positive cell |

Figure 9:
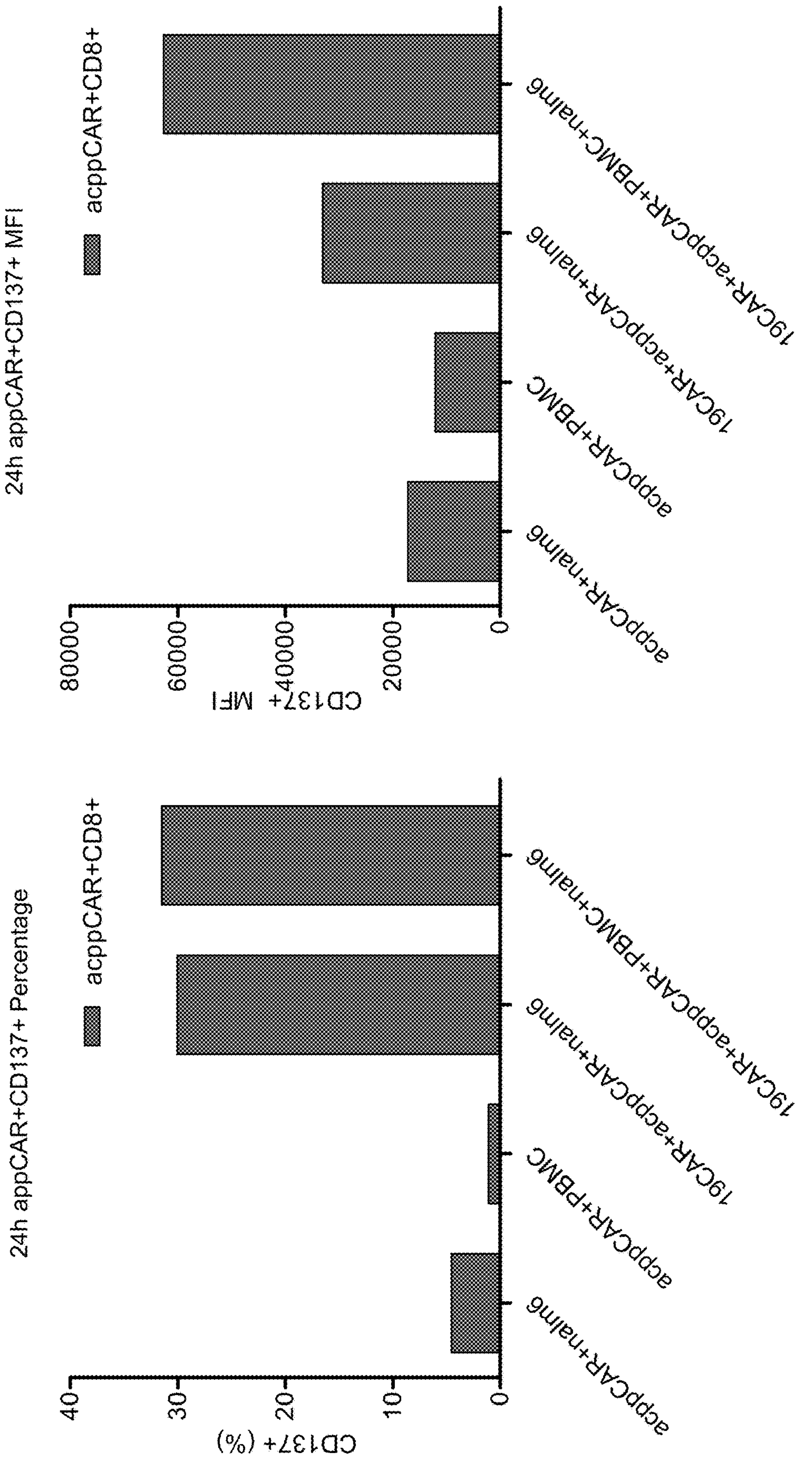
FIG. 9 shows CD137 expression in various cell cultures.

FIG. 9 shows other histograms of CD137 expression in various cell cultures. Peripheral blood of healthy volunteers was collected on day 0. CD3+ T cells were sorted and collected using Pan T kits, and CD3/CD28 Dynabeads were added at a 1:1 ratio to the collected CD3+ T cells. Day 1, CD3+ T cells were transfected with lentivirus encoding CD19 CAR and ACPP CAR, respectively (Table 5). The binding domains of CD19 CAR and ACPP CAR include SEQ ID NOs: 5 and 325, respectively. On day 2, the lentivirus and the Dynabeads were removed, and fresh media were added. On day 7, CAR T cells and target cells were co-cultured for 24 hours and various assays were performed on day 8. Flow cytometry assays were performed, and the results show expression of CD19 CAR and ACPP CAR T cells. As shown in FIG. 9, the activation of the ACPP CART cells was higher, and the activation was increased in presence of PBMC. These results show activation of CD19 CAR T cells by nalm6 can activate ACPP CAR T cells, and this effect is enhanced by PBMC.

Figure 10:
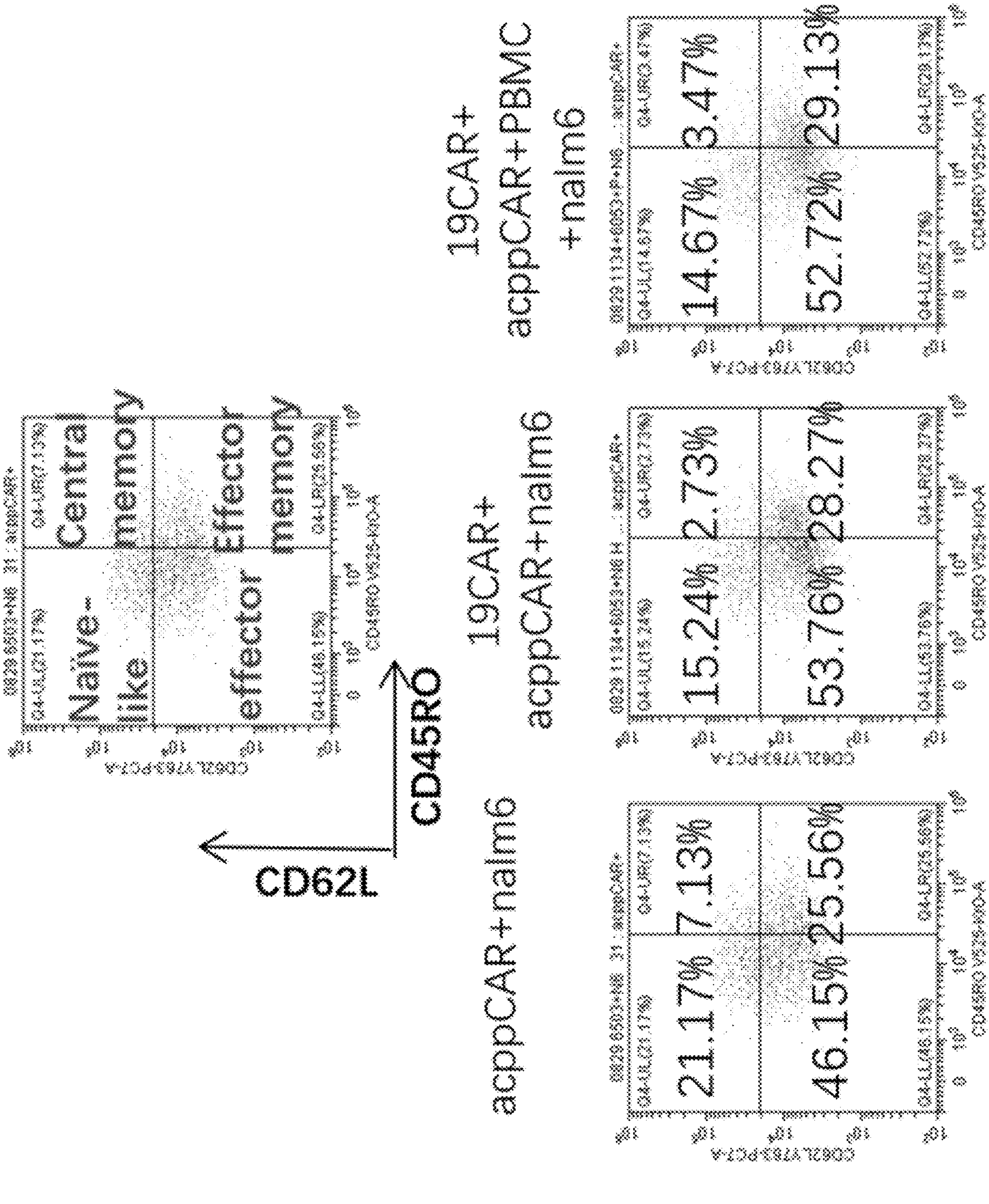
FIG. 10 shows results of flow cytometry analysis of cell activation.

FIG. 10 shows flow cytometry assays of activation analysis. CD45RO and CD62L can be used to divide CAR T cells into four states. Nalm6 activated expression of CD45RO and CD62L on CD19 CAR T cells, and the proportion of effector cells in ACPP CAR T cells increased. These results show that the activation of CD19 CAR T cells induced ACPP CAR T cells to a functional state, which acted as the pre-activation of ACPP CAR T cells.

Figure 11:
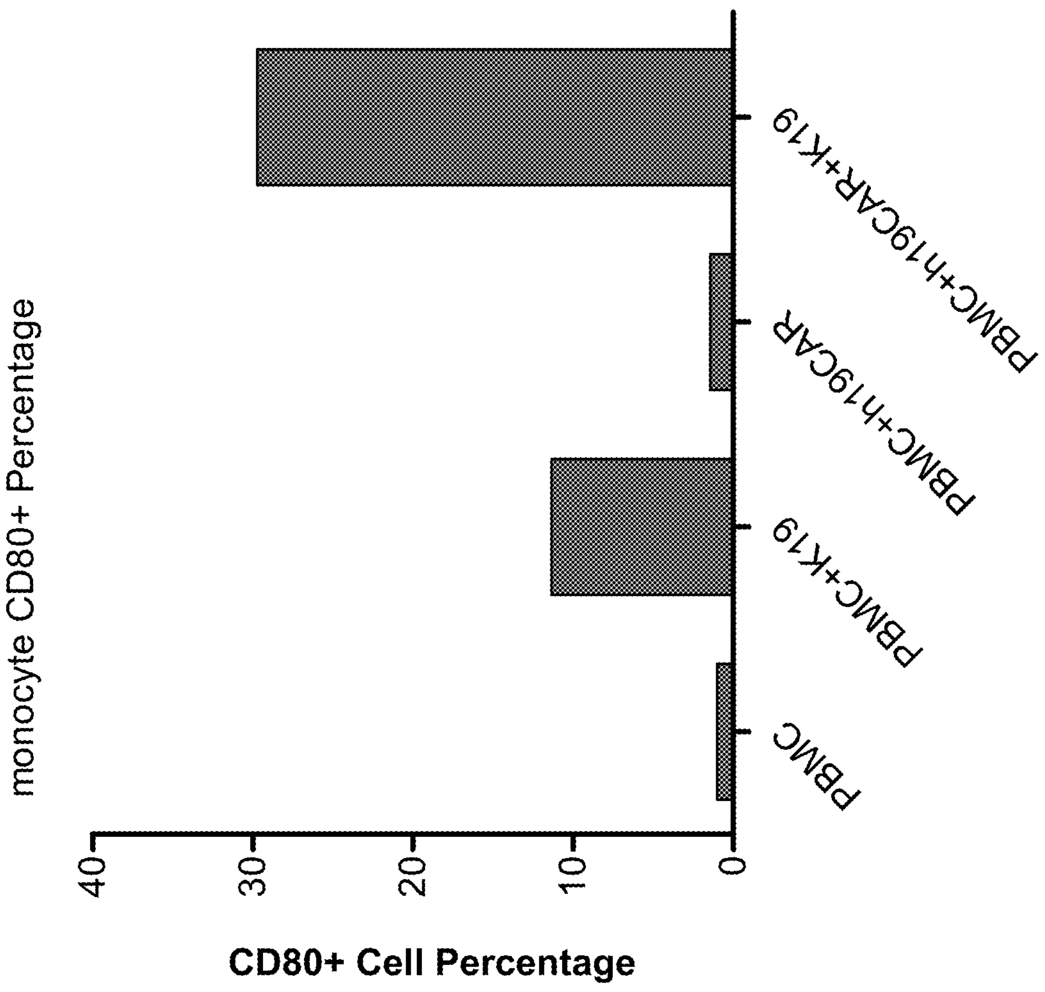
FIG. 11 shows the activation of PBMC and monocyte in the cell cultures described in FIG. 9.

FIG. 11 shows the activation of PBMC and monocyte in the cell cultures described in FIG. 9. Flow cytometry assays showed monocyte (CD14+) and activated monocyte (CD14+&CD80+) in PBMC. h19CAR is a humanized CD19 CAR, and the groups include (1) PBMC alone, (2) PBMC and K19, (3) PBMC and CD19 CAR T cells, (4) PBMC and K19 and CD19 CAR T cells. These results indicate that activation the CAR T cells is capable of activating PBMC.

Figure 12:
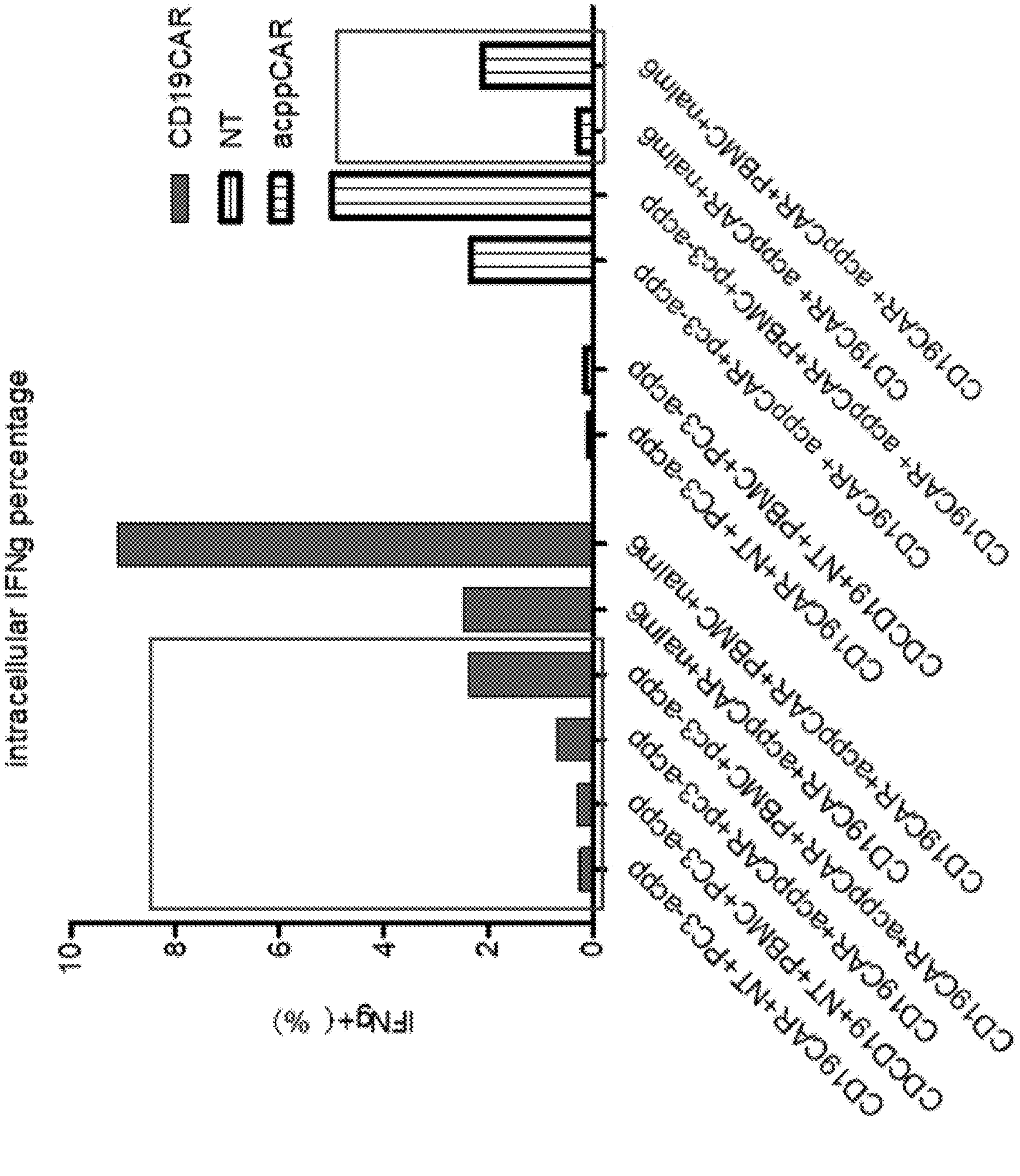
FIG. 12 shows that activation of CD19 CART cells causes ACPP CAR (acppCAR) T cells to release intracellular IFNγ.

FIG. 12 shows that activation of CD19 CART cells induces ACPP CAR T cells to release intracellular IFNγ. Similar to above, various cells were cultured on day 7, and flow cytometry assays were performed on day 8. When both CAR T cells were present and there was PBMC in the system, ACPP CAR T cells also showed enhanced IFN-γ release.

Figure 13:
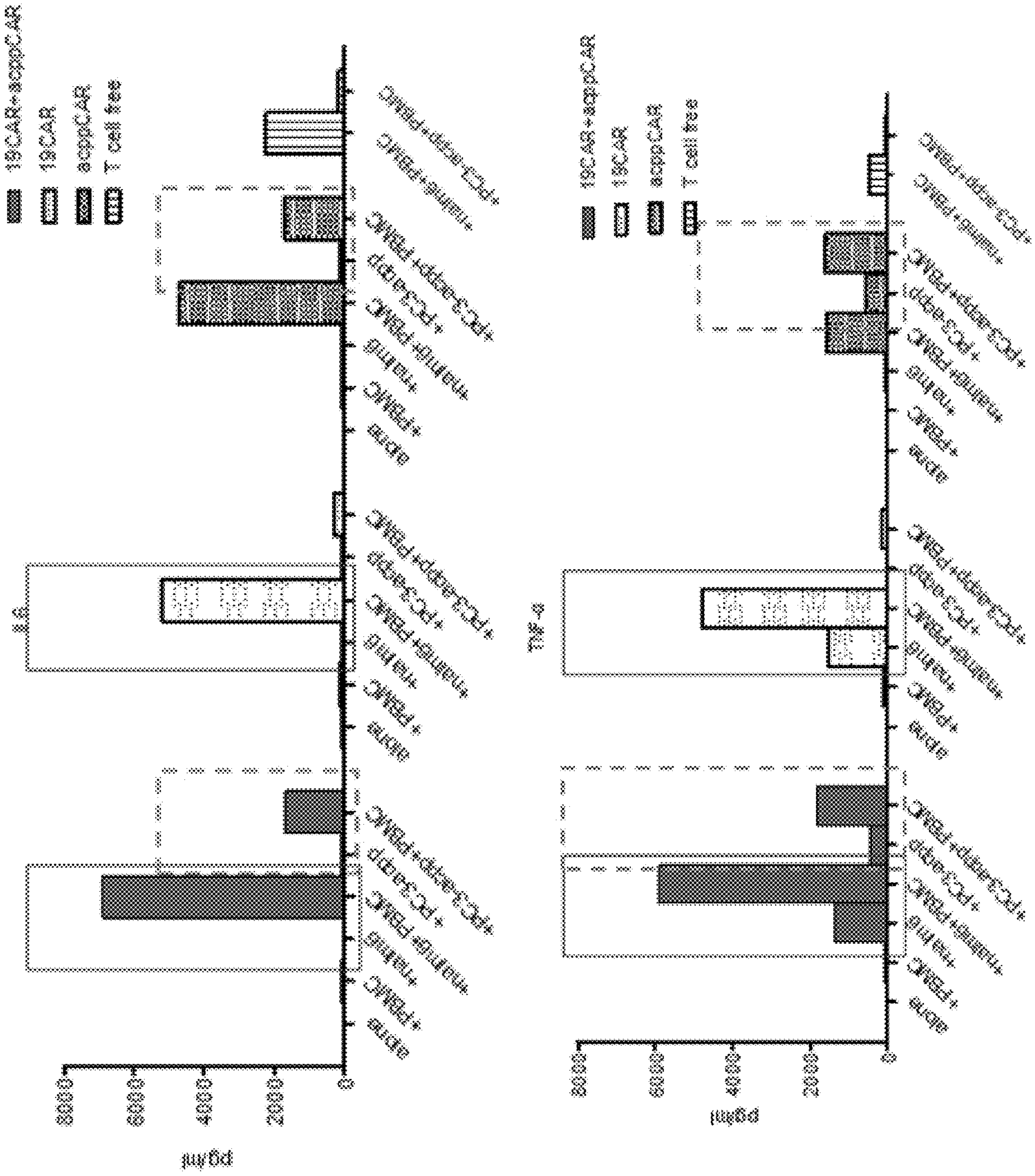
FIGS. 13 and 14 show cytokine release after cells are co-cultured for 24 hours (hrs) in cell cultures.
Figure 14:
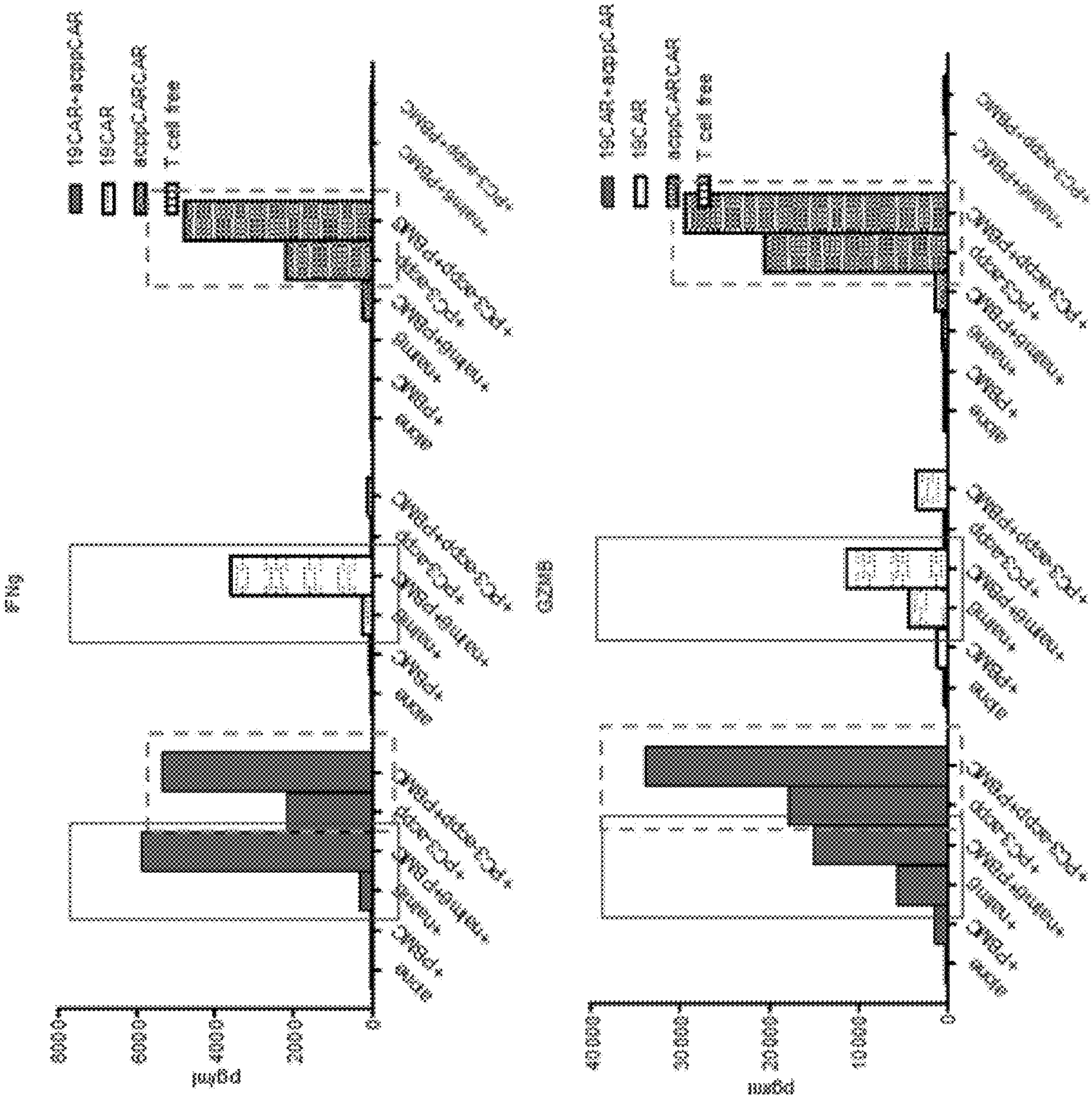

FIGS. 13 and 14 show cytokine release after cells were co-cultured for 24 hrs in cell cultures. There are limited amounts of TNF-α, IFN-γ, GZMB released in the control group. The coupled CAR group (CD19 CART cells and ACPP CART cells) and single CAR group (CD19 CAR T cells or ACPP CAR T cells) were labeled with solid line and dotted line, respectively. The levels of TNF-α, IFN-γ, GZMB released are similar in the absence of PBMC. When PBMC was added, the amount of TNF-α, IFN-γ, GZMB released increased. IL6 was mainly secreted by PBMC, and the amount of released cytokines was enhanced in the coupled CAR group in the presence of PBMC.

TABLE 6

| CAR T cells and substrate cells used in Group 3 | | | |
|---|---|---|---|
| Coupled CART cells | CD19 CAR T cells & CLDN 18.2 CAR T cells | | |
| CAR T Cell ID | CAR | Substrate Cell | Note |
| 1234 | CD19 CAR | K19 | CD19 positive Cell |
| 6503 | CLDN 18.2 CAR | KATO3 | CLDN 18.2 positive cell |

Figure 15:
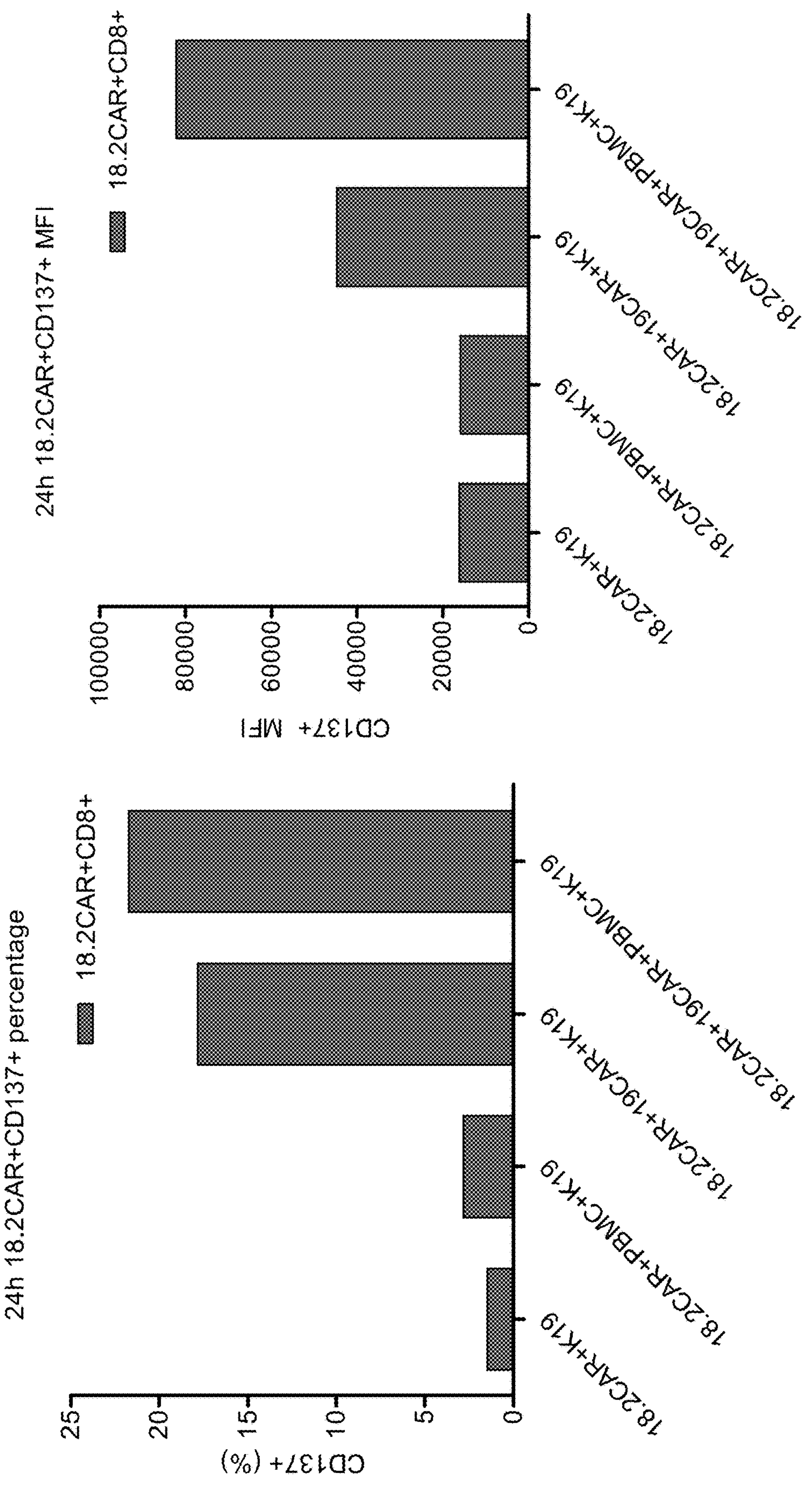
FIG. 15 shows CD137 expression in various cell cultures.

FIG. 15 provides additional histograms showing CD137 expression in various cell cultures. Peripheral blood of healthy volunteers was collected on day 0. CD3+ T cells were sorted using Pan T kits, and CD3/CD28 Dynabeads were added at a 1:1 ratio. On day 1, CD3+ T cells were transfected with lentivirus encoding CD19 CAR and CLDN 18.2 CAR (Table 6), respectively. The binding domains of CD19 CAR and CLDN 18.2 CAR include SEQ ID NOs: 5 and 275, respectively. On day 2, the lentivirus and the Dynabeads were removed, and fresh media were added. On day 7, CAR T cells and target cells were cocultured for 24 or 48 hours and various assays were performed on day 8. As shown in FIG. 15, the activation of the CLDN18.2 CART cells was higher, and the activation was enhanced in the presence of PBMC. These results show that activation of CD19 CART cells by K19 can indirectly activate CLDN18.2 CART cells, and this effect is enhanced by PBMC.

Figure 16:
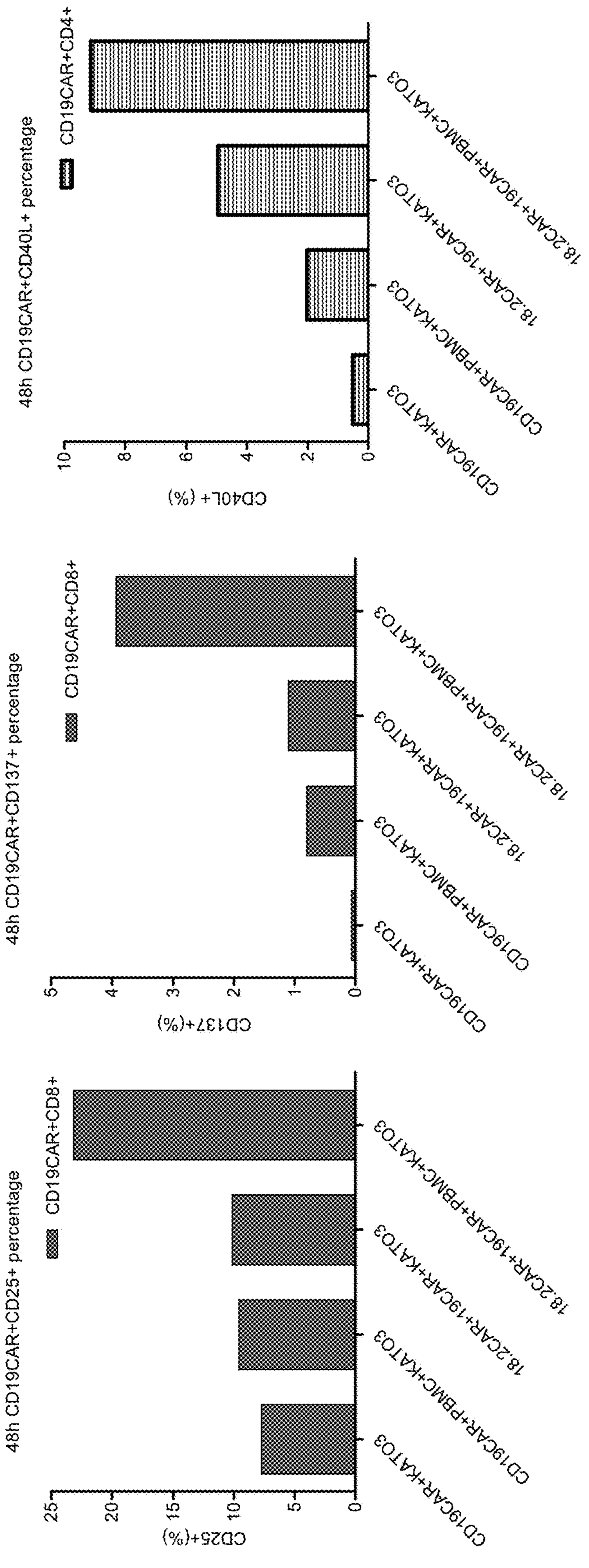
FIG. 16 shows results of flow cytometry analysis of various CART cells co-cultured with KATO3+ cells for 48 hours.

FIG. 16 shows results of flow cytometry analysis of various CART cells cocultured with KATO3+ cells for 48 hours. It can be seen from the histograms that the level of activation of CD19 CART cells in the coupled CART group (CD19 CART cells and CLDN 18.2 CAR) was higher than in the single CART group (CD19 CART cells or CLDN 18.2 CAR) in the presence of KATO3+ cells. The level of activation of CD19 CAR T cells was higher after being activated in the presence of PBMC (e.g., the ratio of CD25 and CD137), indicating that CD19 CART cells can be activated by activation of CLDN18.2 CART cells by KATO3+ cells, which was enhanced by PBMC. CD40L is mainly expressed by CD4 T cells (interacting with CD40L+ cells in PBMC, such as B cells, activated monocytes, DC). The results show that activation of CLDN18.2 CAR T cells by KATO3+ cells can up-regulate the expression of CD40L of CD19 CAR T cells, which can activate B cells and mononuclear cells. This effect was enhanced by PBMC.

Figure 17:
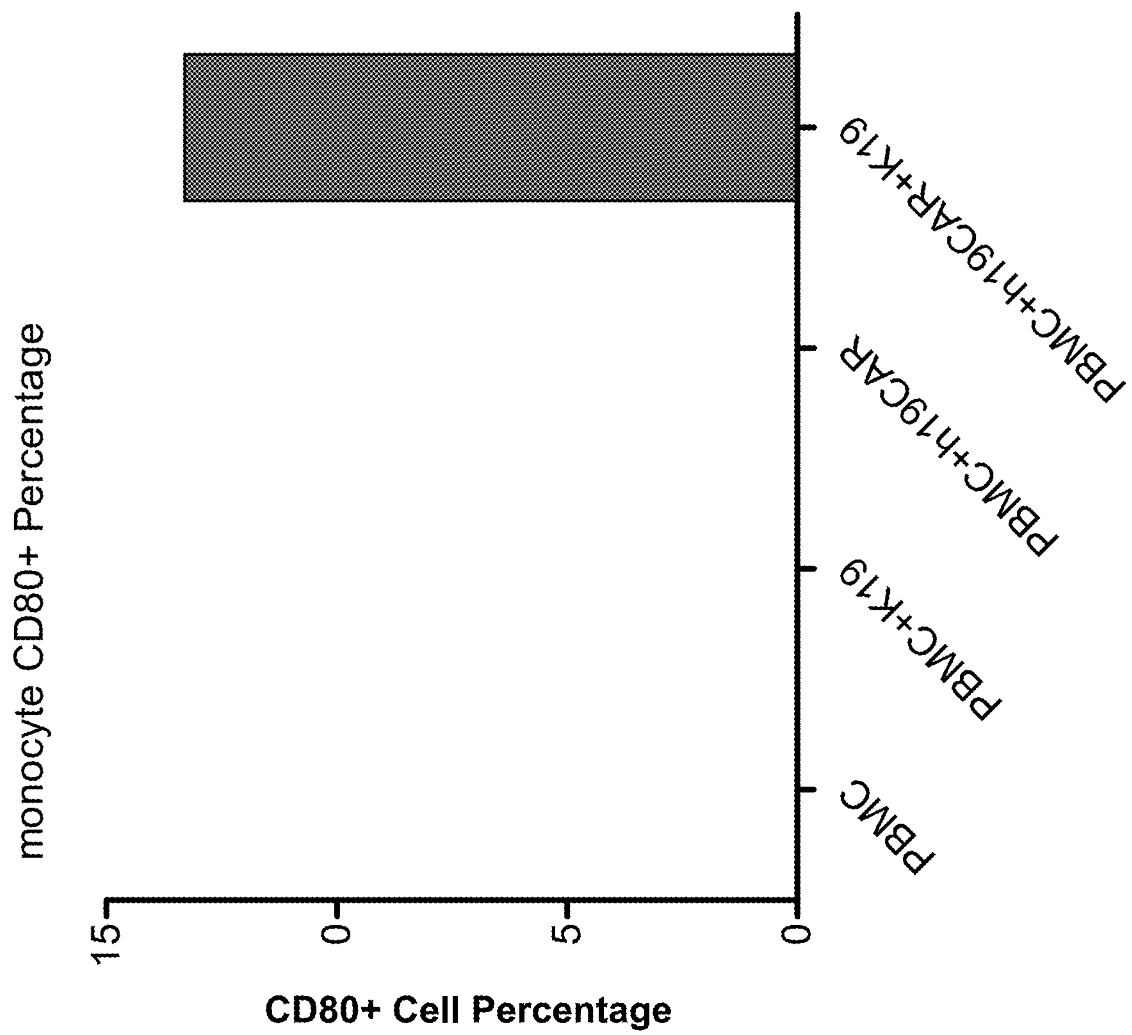
FIG. 17 shows the activation of PBMC and monocyte in the systems described in FIG. 50.

FIG. 17 shows the activation of PBMC and monocyte in the systems described in FIG. 15. h19CAR is a humanized CD19 CAR, and the groups include (1) PBMC alone, (2) PBMC and K19, (3) PBMC and CD19 CAR T cells, (4) PBMC, K19, and CD19 CART cells. As shown in FIG. 17, last column of PBMCs shows activation, indicating that activation of the CAR T cells is capable of activating PBMC.

Figure 18:
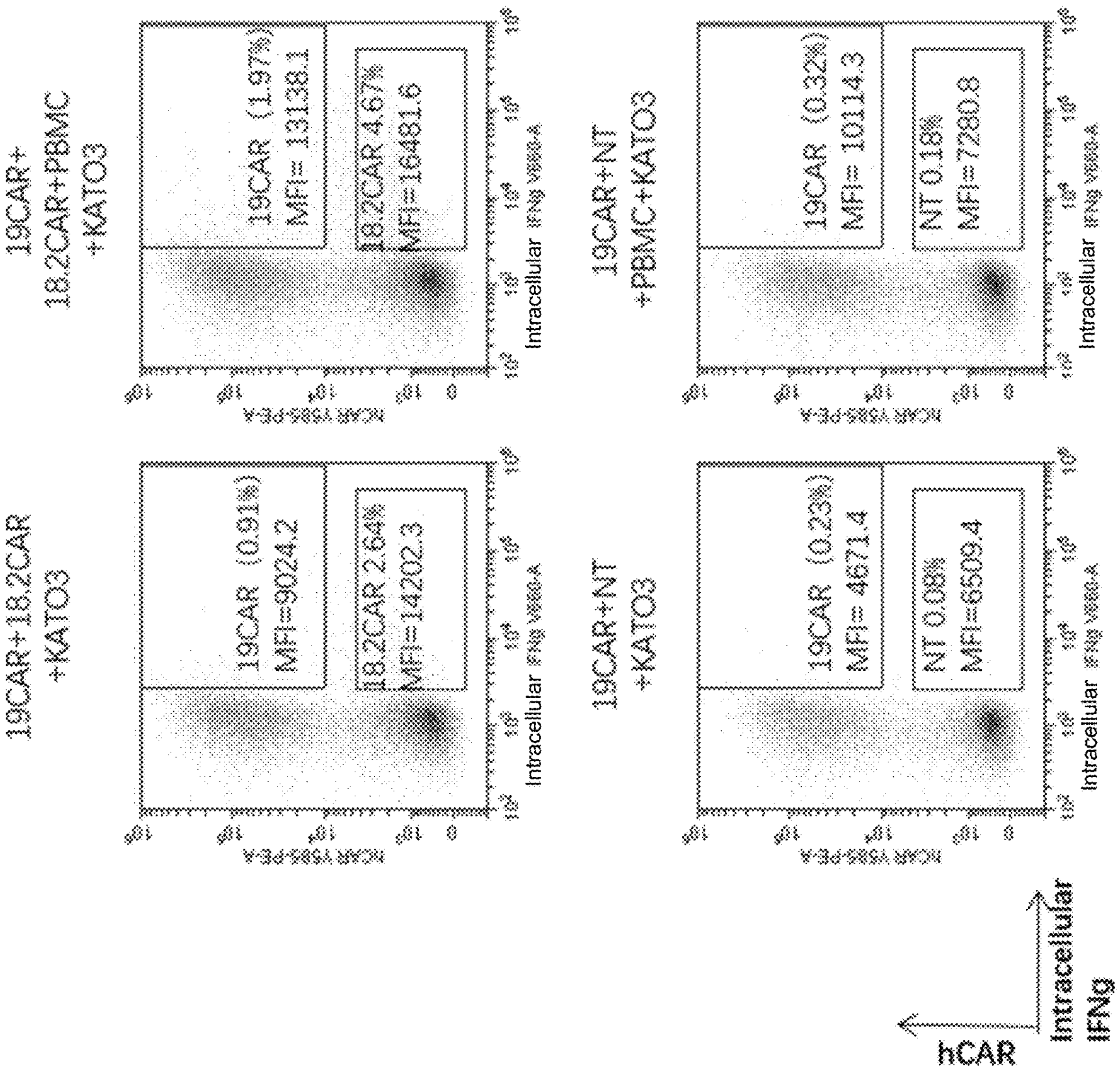
FIGS. 18 and 19 show activation of CLDN18.2 CART cells causes CD19 CAR T cells to release intracellular IFNγ.
Figure 19:
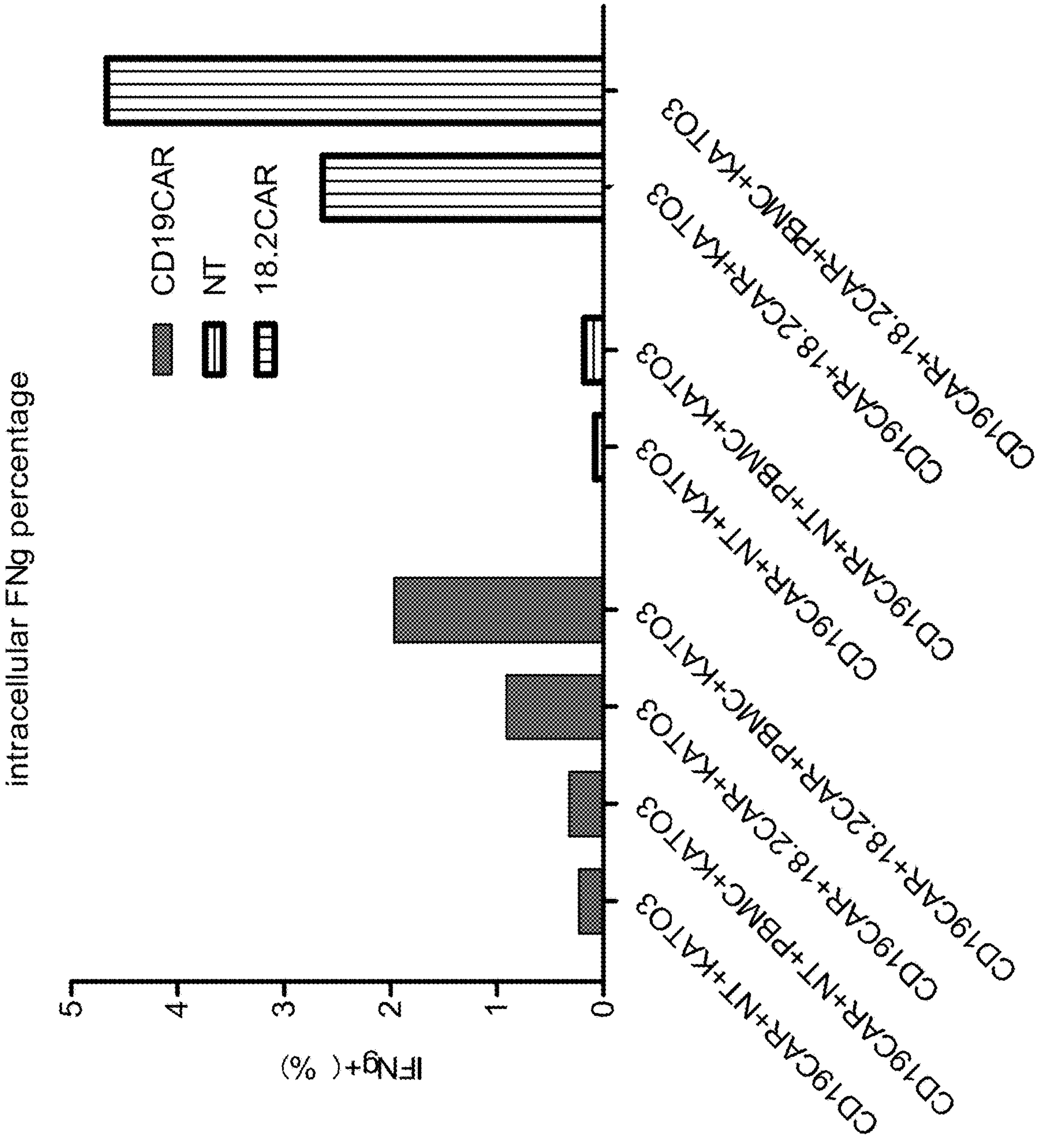

FIGS. 18 and 19 show that activation of CLDN18.2 CART cells induces CD19 CAR T cells to release intracellular IFNγ. Similar to those in FIGS. 39 and 39, the amount of IFNγ released in the coupled CART cell group (CD19 CART cells and CLDN 18.2 CAR) was more than that of the single type CART cell group (CD19 CAR T cells or CLDN 18.2 CAR), and the addition of PBMC can upregulate this effect.

FIG. 20 shows killing assays for various cell cultures. The starting amount of both substrate cells is $2.0\times10^5$/600 ul or $3.33\times10^5$/ml. FIG. 20 shows the cell density of the substrate cells after three days of killing. PBMC helped the killing of the substrate cells, and the coupled CAR T cell group (CD19 CAR T cells and CLDN 18.2 CAR) enhanced the killing effect of CD19 CAR T cells alone or CLDN18.2 CART cells alone. In the presence of PBMC, the coupled CAR T cells had better killing effects, demonstrating that the activated CAR T cells can activate PBMC and further activate another type of CAR T cells in the coupled CAR T cell group to release cytokines and enhance the efficacy when a type of CAR T cells in a coupled CAR T system is activated.

Figure 21:
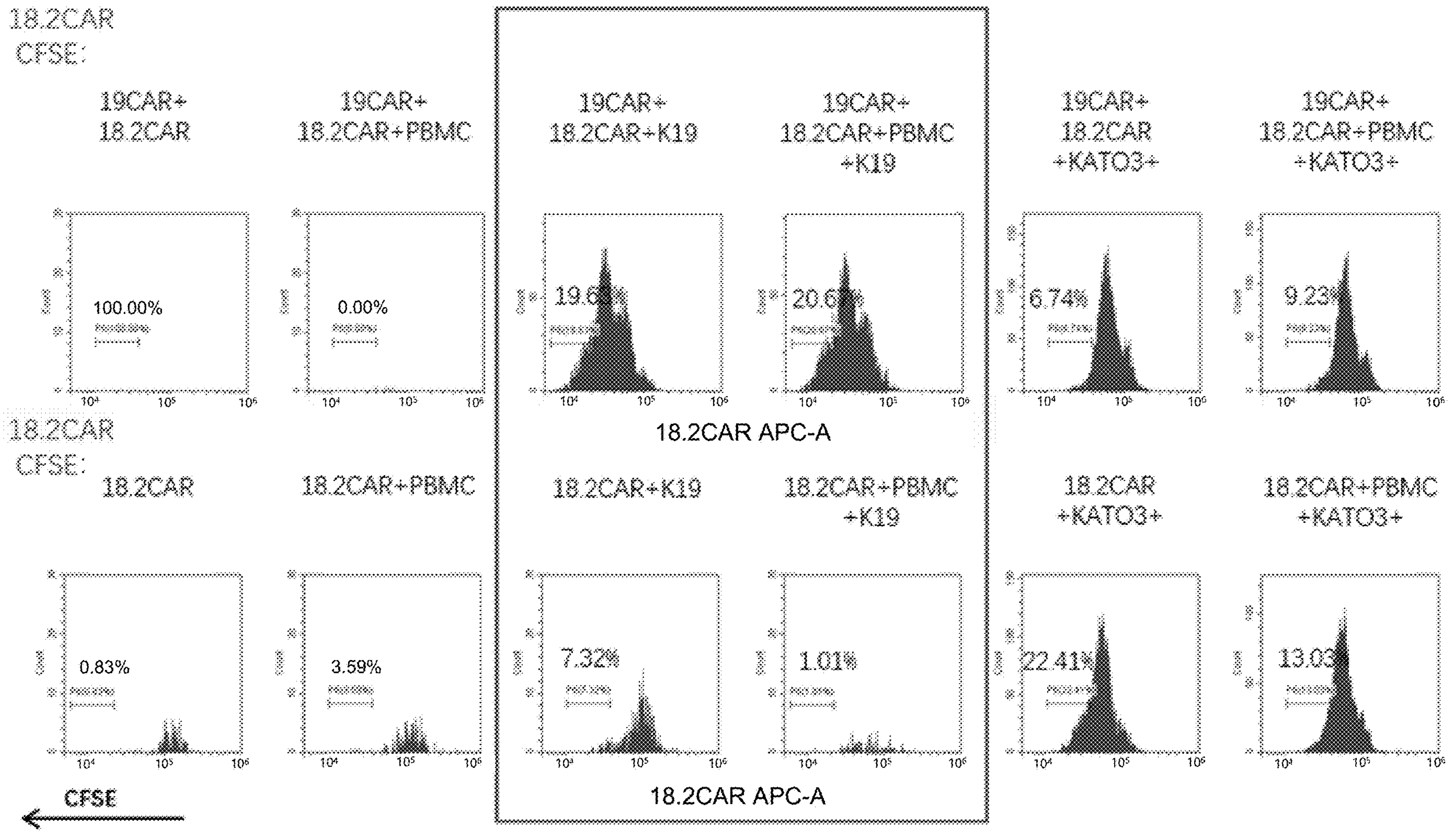
FIG. 21 shows proliferation of CLDN18.2 CART cells.

FIG. 21 shows the proliferation of CLDN18.2 CART cells. Various cells were cultured on day 7, and flow cytometry assays were performed on day 8. Further, CFSE reaction was measured to evaluate levels of proliferation. As shown in FIG. 21, the first row is the experimental group comprising coupled CAR co-cultured with two substrate cells, and the second row is the control group comprising CLDN18.2CAR co-cultured with two substrate cells. FIG. 21 shows that the activation of CD19 CAR T cells with K19 can induce the proliferation of CLDN18.2CAR T cells. KATO3 cells can be effectively activated by CLDN18.2 CART cells and then were proliferated. The presence of PBMC can further enhance proliferation. The results demonstrate that CD19 CAR is efficiently activated by K19 in the coupled CAR group and activated CD19 CAR T can activate CLDN18.2 CART cells to promote proliferation CLDN18.2 cells, which can be further enhanced by the PBMC.

Figure 22:
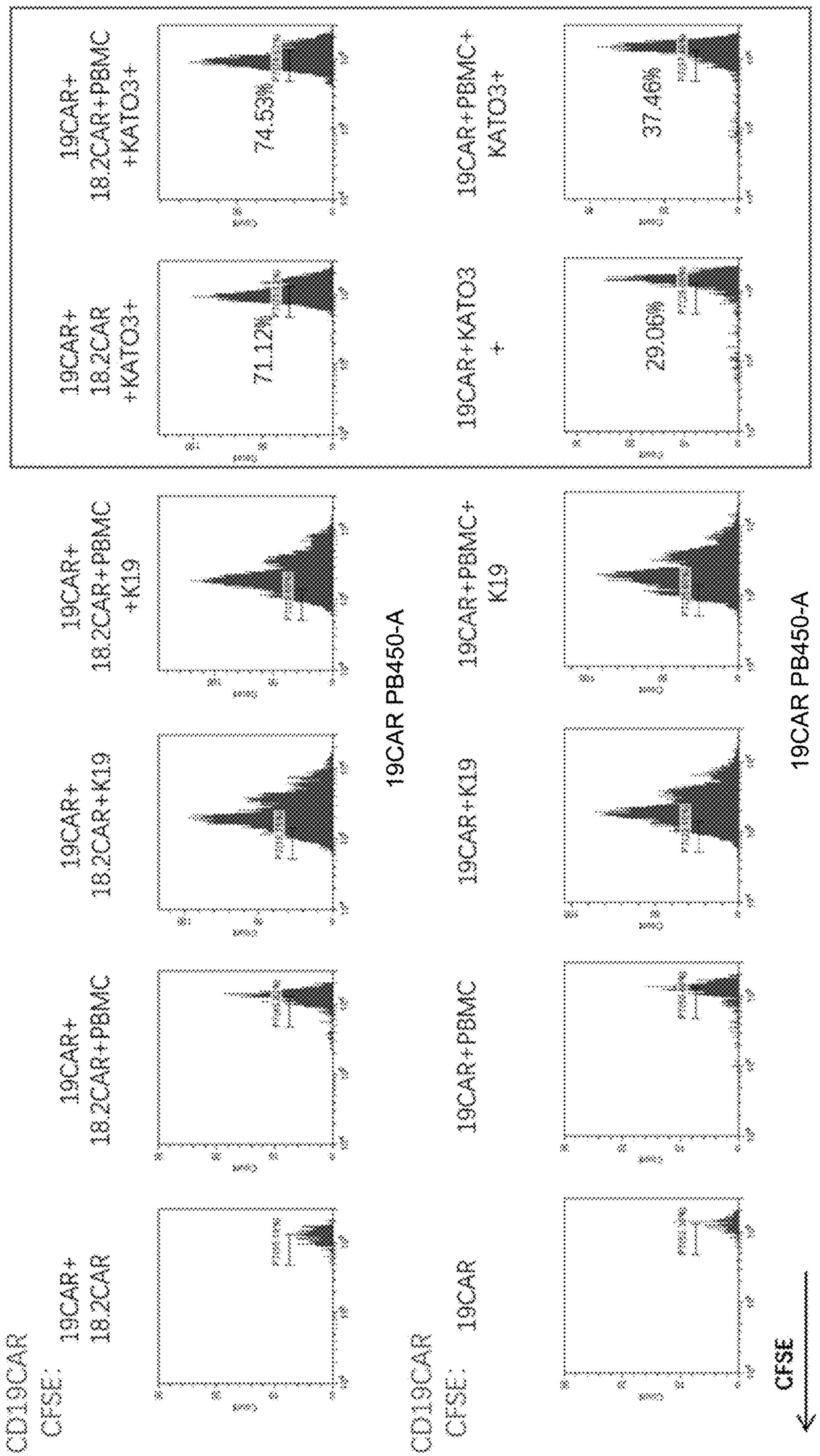
FIG. 22 shows proliferation of CD19 CART cells in CLDN18.2 CAR and CD19 CAR systems.

FIG. 22 shows proliferation of CD19 CART cells. Various cells were cultured on day 7, and flow cytometry assays were performed on day 8. Further, CFSE reaction was measured to evaluate the levels of proliferation. Further, CFSE reaction was measured to evaluate the levels of proliferation. As shown on FIG. 22, the first row is the experimental group comprising couple CAR T cells co-cultured with two substrate cells, and the second row comprising the control group CD19 CART cells co-cultured with two substrate cells. FIG. 22 shows that activation of CLDN18.2 CAR T cells with KATO3+ cells can induce the proliferation of CD19 CAR T cells. The fifth and sixth columns show that PBMC can further enhance proliferation of CD19 CART cells. The results demonstrate that CLDN18.2 CART cells were activated by KATO3+ cells in the coupled CAR group and activated CLDN18.2 CAR T cells can activate CD19 CAR T cells to promote the proliferation of CD19 CAR T cells, which can be further enhanced by PBMC.

Figure 23:
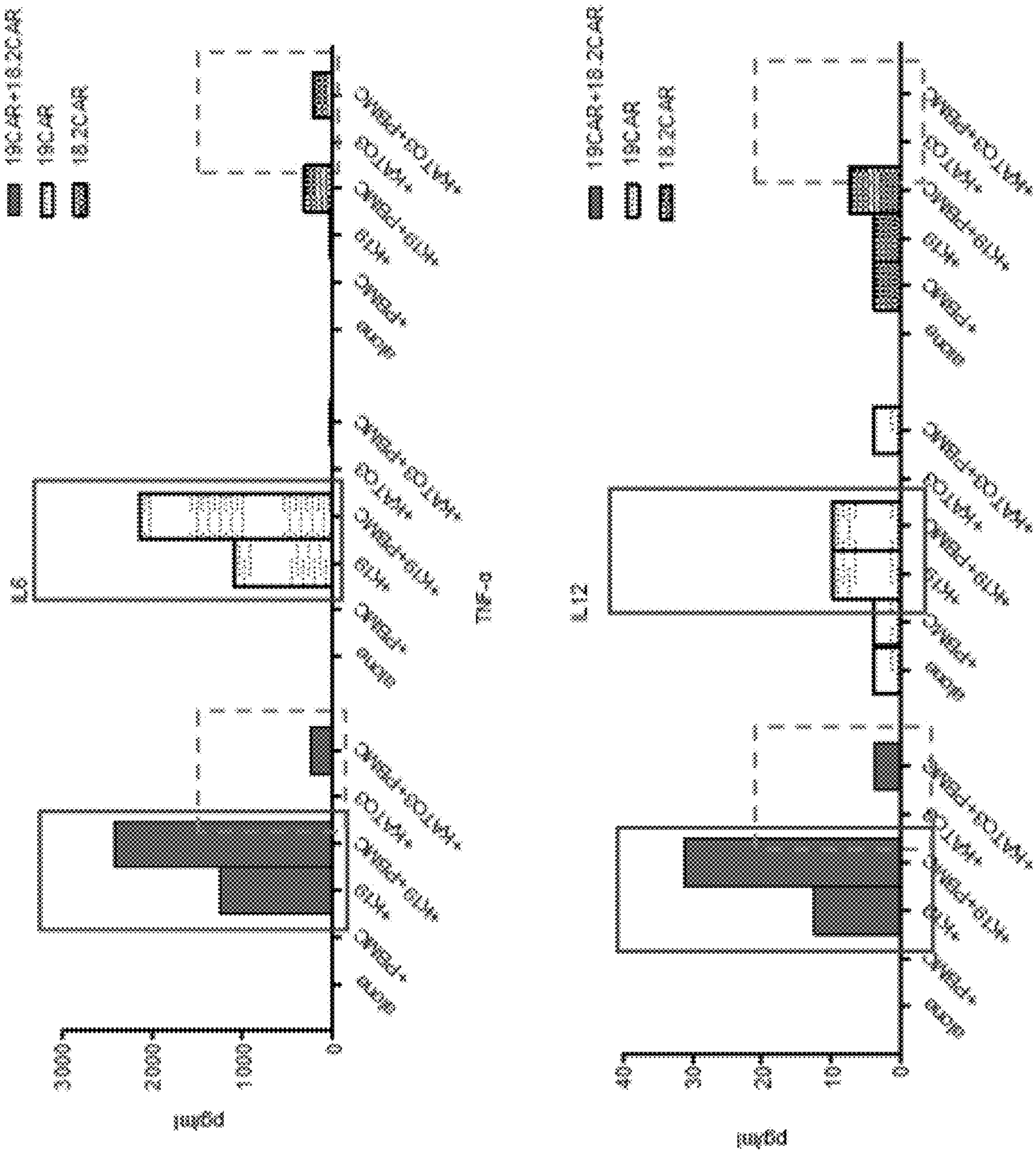
FIGS. 23, 24, and 25 show cytokine release in various cell cultures.
Figure 24:
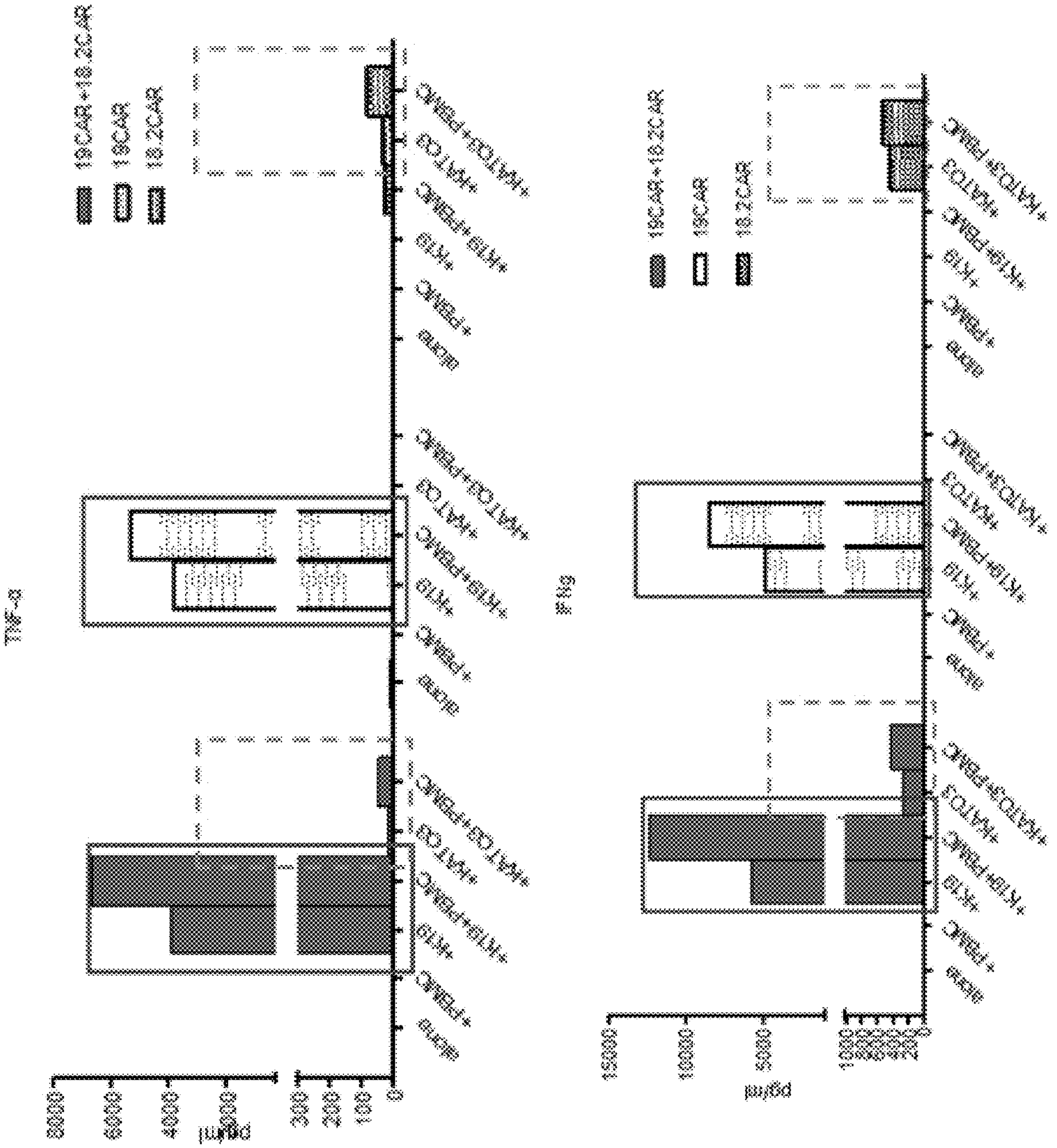
Figure 25:
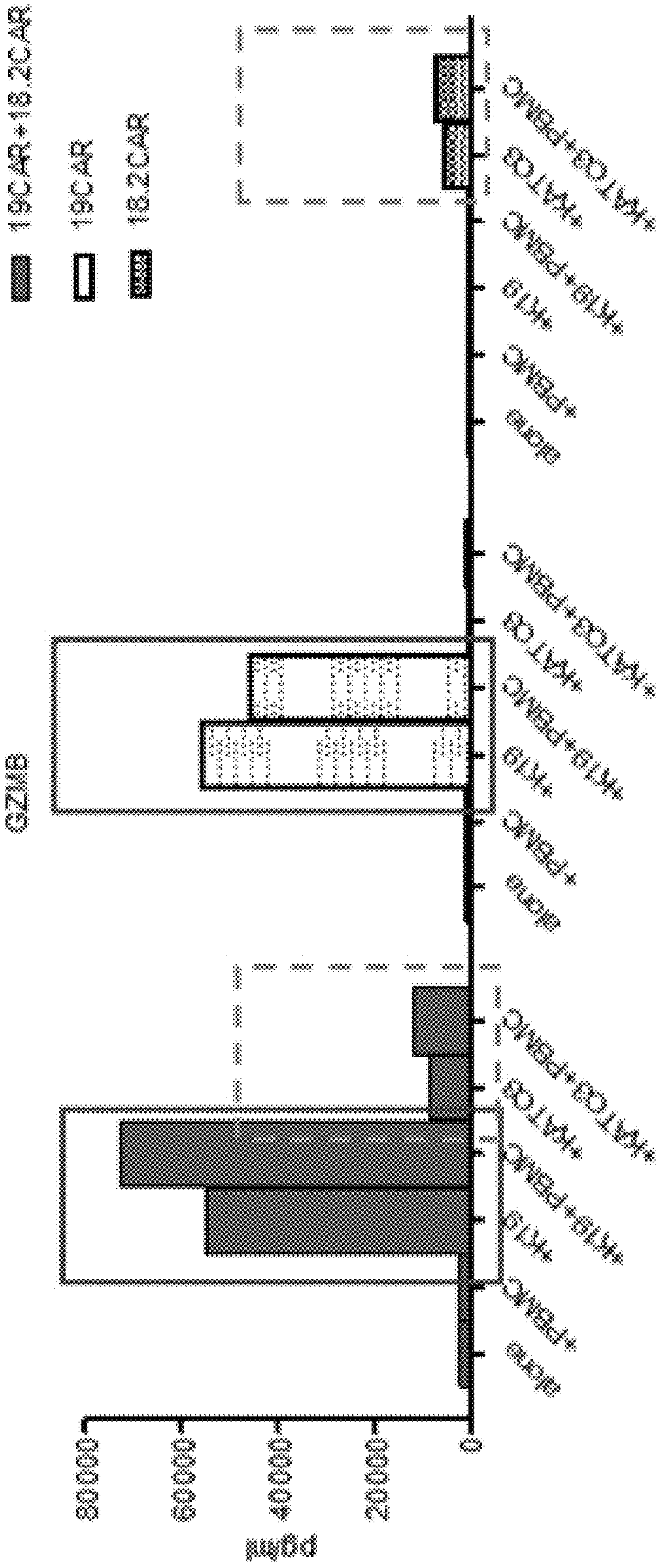
Figures 26A, 26B, 26C, 26D:
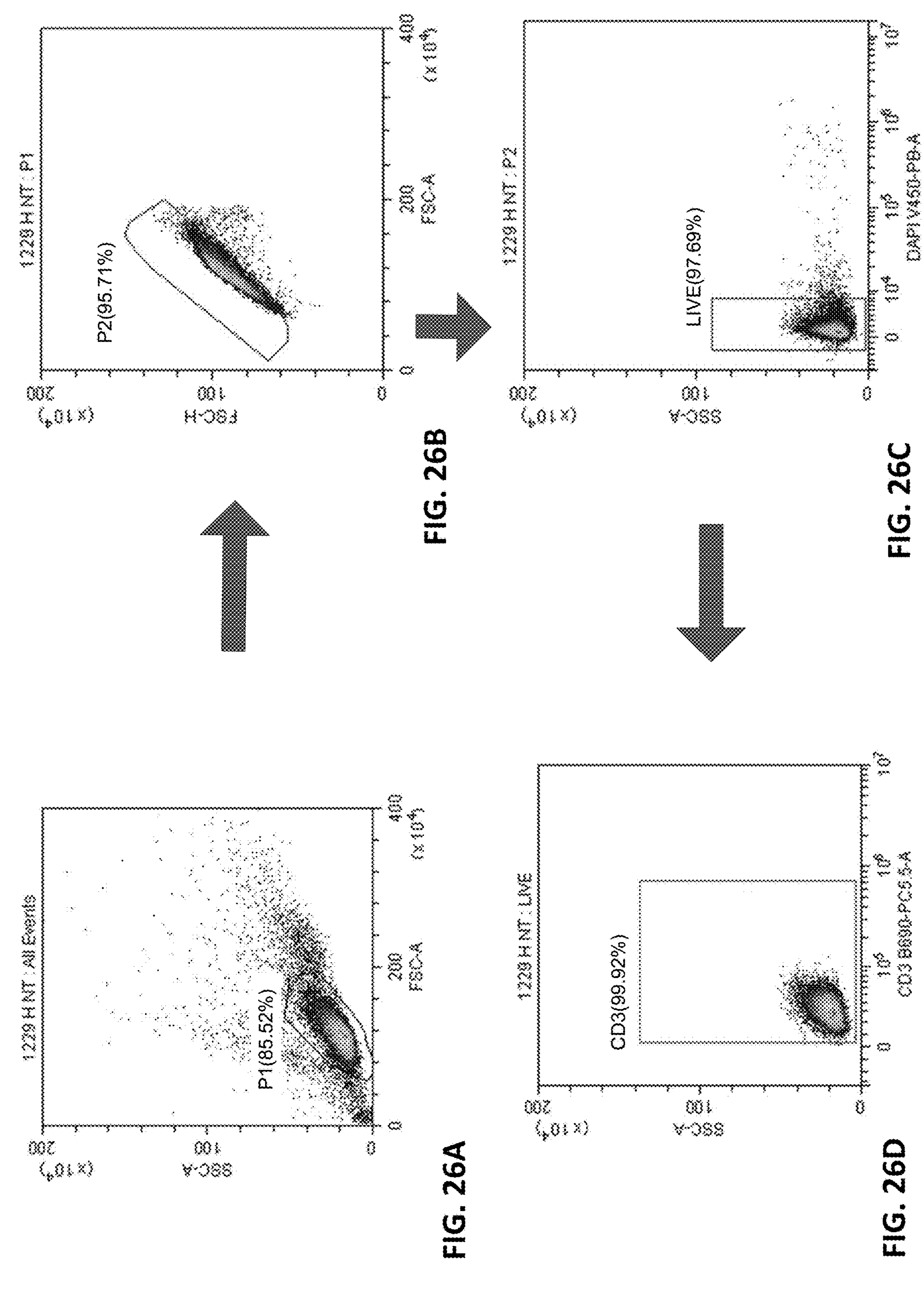
FIGS. 26A-26D illustrates the determination of phenotype and expression of a gene of interest using flow cytometry.

FIGS. 23-25 show cytokine release in various cell cultures. Various cells were cultured on day 7, and flow cytometry assays were performed on day 8. As shown, limited amounts of IL12, IFNγ and GZMB were released in the control group. The coupled CAR T cell group and single CAR T cell group were labeled with solid line and dotted line, respectively. The amount of IL12, IFNγ and GZMB released is similar in the absence of PBMC. When PBMC was added, the amount of IL12, IFNγ and GZMB released increased.

TABLE 7

| CAR T cells and substrate cells used in Group 4 | | | |
|---|---|---|---|
| Coupled CAR T cells | CD19 CAR T cells & ACPP CAR cells | | |
| CAR T Cell ID | CAR | Substrate Cell | Notes |
| 6404 | BCMA CAR | 8226 | BCMA positive Cell |
| 6701 | GUCY2C CAR | T84 | GUCY2C positive cell |

Figure 32:
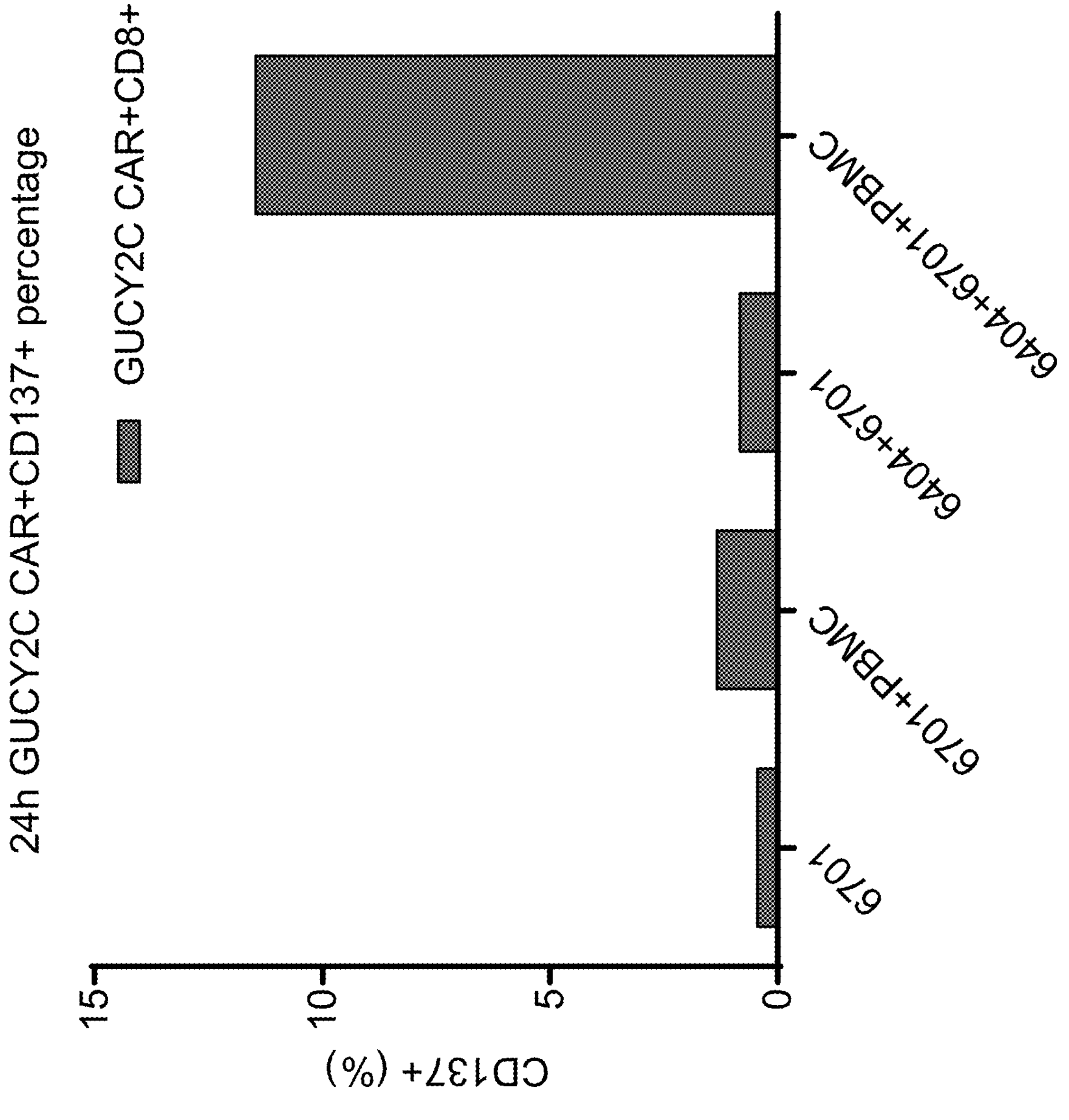
FIG. 32 shows other histograms of CD137 expression in various cell cultures.

FIG. 32 shows other histograms of CD137 expression in various cell cultures. Peripheral blood of healthy volunteers was collected on day 0. CD3+ T cells were sorted and collected using Pan T kits, and CD3/CD28 Dynabeads were added at a 1:1 ratio to the collected CD3+ T cells. On day 1, CD3+ T cells were transfected with lentivirus encoding BCMA CAR and GUCY2C CAR, respectively (Table 7). The binding domains of CD19 CAR and ACPP CAR include SEQ ID NOs: 56 and 324, respectively. On day 2, the lentivirus and the Dynabeads were removed, and fresh media were added. On day 7, CAR T cells and target cells (e.g., 8226) were co-cultured for 24 hours and various assays were performed on day 8. Flow cytometry assays were performed, and the results show expression of CD19 CAR and ACPP CART cells. As shown in FIG. 32, the activation of the GUCY2C CAR T cells was higher, and the activation was increased in the presence of PBMC. These results show activation of BCMA CAR T cells by 8226 can activate GUCY2C CAR T cells, and this effect is enhanced by PBMC. Since PBMC includes B cells and plasma cells that include BCMA, PBMC can activate BCMA CAR T cells. The activation of BCMA CAR T cells by PMBC is enhanced by GUCY2C CAR T cells.

Figure 33:
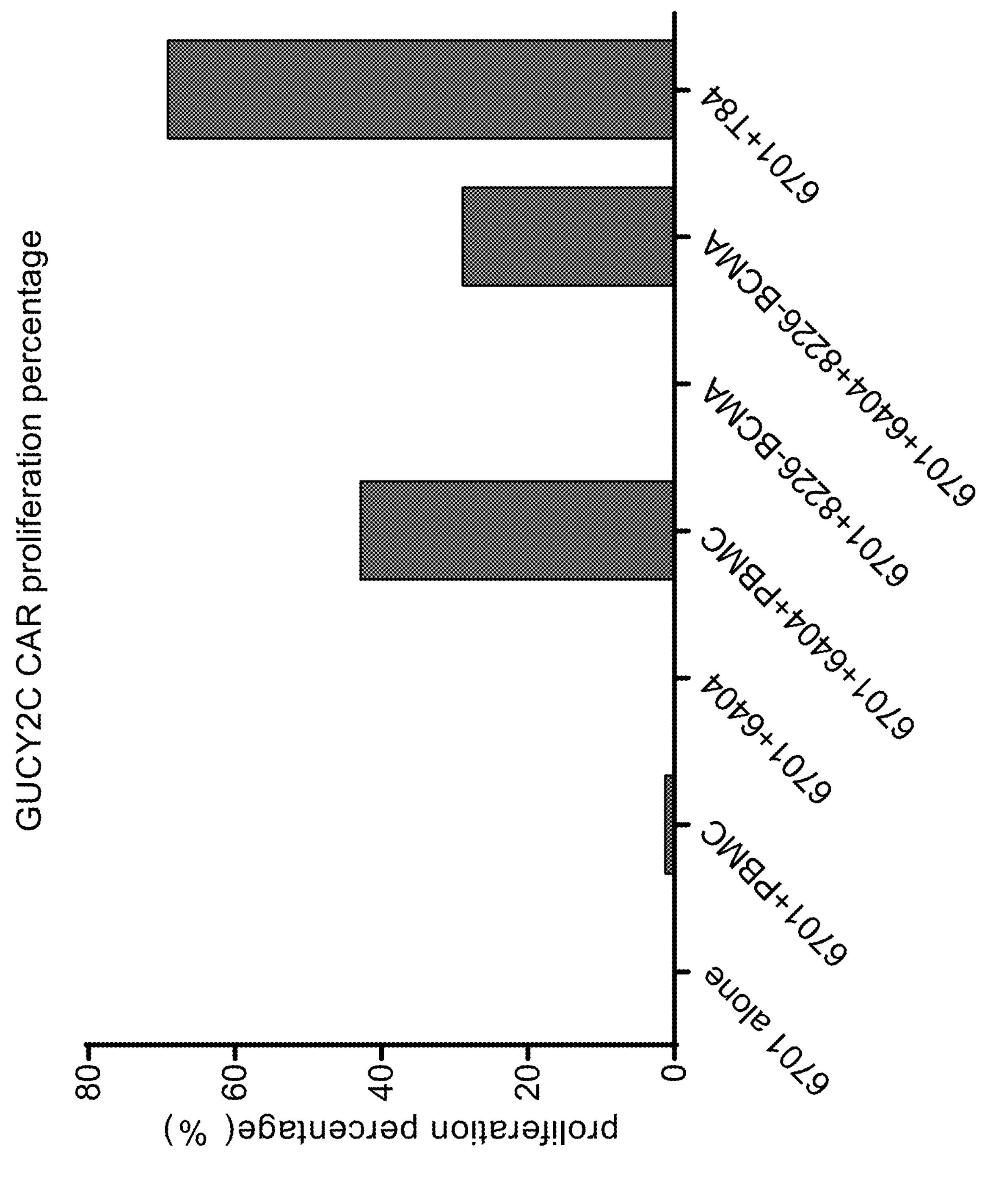
FIG. 33 shows the proliferation of GUCY2C CAR T cells.

FIG. 33 shows the proliferation of GUCY2C CAR T cells. Various cells were cultured on day 7, and flow cytometry assays were performed on day 8. Further, CFSE reaction was measured to evaluate levels of proliferation. PMBC includes B cells and plasma cells, which include BCMA. As shown in FIG. 33, the activation of BCMA CAR T cells with PMBC can induce the proliferation of GUCY2C CAR T cells.

Figure 34:
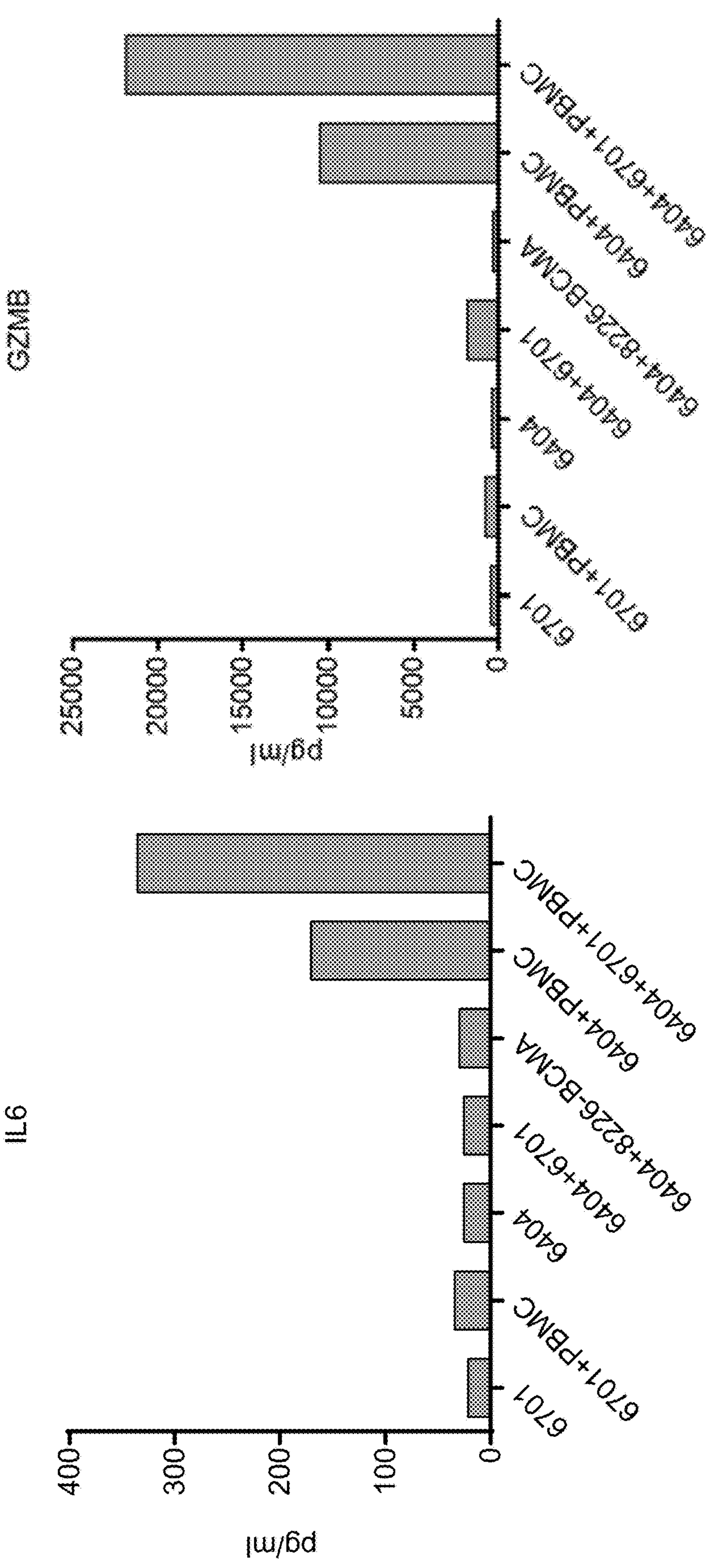
FIG. 34 shows cytokine release after cells were co-cultured for 24 hrs in cell cultures.

FIG. 34 shows cytokine release after cells were co-cultured for 24 hrs in cell cultures. There are limited amounts of IL-6, IFN-γ, GZMB released in the control group. The levels of IL-6 and GZMB released are similar in the absence of PBMC. When PBMC was added, the amount of IL-6 and GZMB released increased. The amount of released cytokines was enhanced in the coupled CAR group in the presence of PBMC.

NY-ESO-1 transduced T cells (NYESO-1 TCRTS or 8302) and AFP transduced T cells (AFP TCRTS or DW105) were mixed with CD19 CART cells (1234), respectively, and co-cultured with various corresponding target cells (e.g., K19: K562-CD19). FIGS. 26A-26D illustrate the determination of phenotype and expression of a gene of interest using flow cytometry. After the mixed cells were co-cultured for 7 days, flow cytometry was used to detect the phenotype of the cells and the expression of the gene of interest. For example, an approximate range of live cells was delineated (FIG. 26A), the adhesion cells were removed (FIG. 26B), DAPI staining was performed to delineate the living cell population (FIG. 26C), and the CD3 positive cell population (i.e., T cells) was delineated FIG. 26D). Flow cytometry was used to determine the cell phenotype and CAR expression. For NT (T cells not expressing CAR) and CD19 CART Groups, CD8 percentages of NYESO-1 TCRTS and AFP TCRTS were 70.32%, 56.44%, 73.85% and 72.74% respectively. CD19 CAR expression was 63.71%, the expression of NYESO-1 TCR was 88.80%, and the expression of AFP TCR was 71.61%. The expression phenotypes of the cells were normal; the expression of CD137 was low; and the cells were already in a resting state, which could be used for subsequent experiments.

Figure 27:
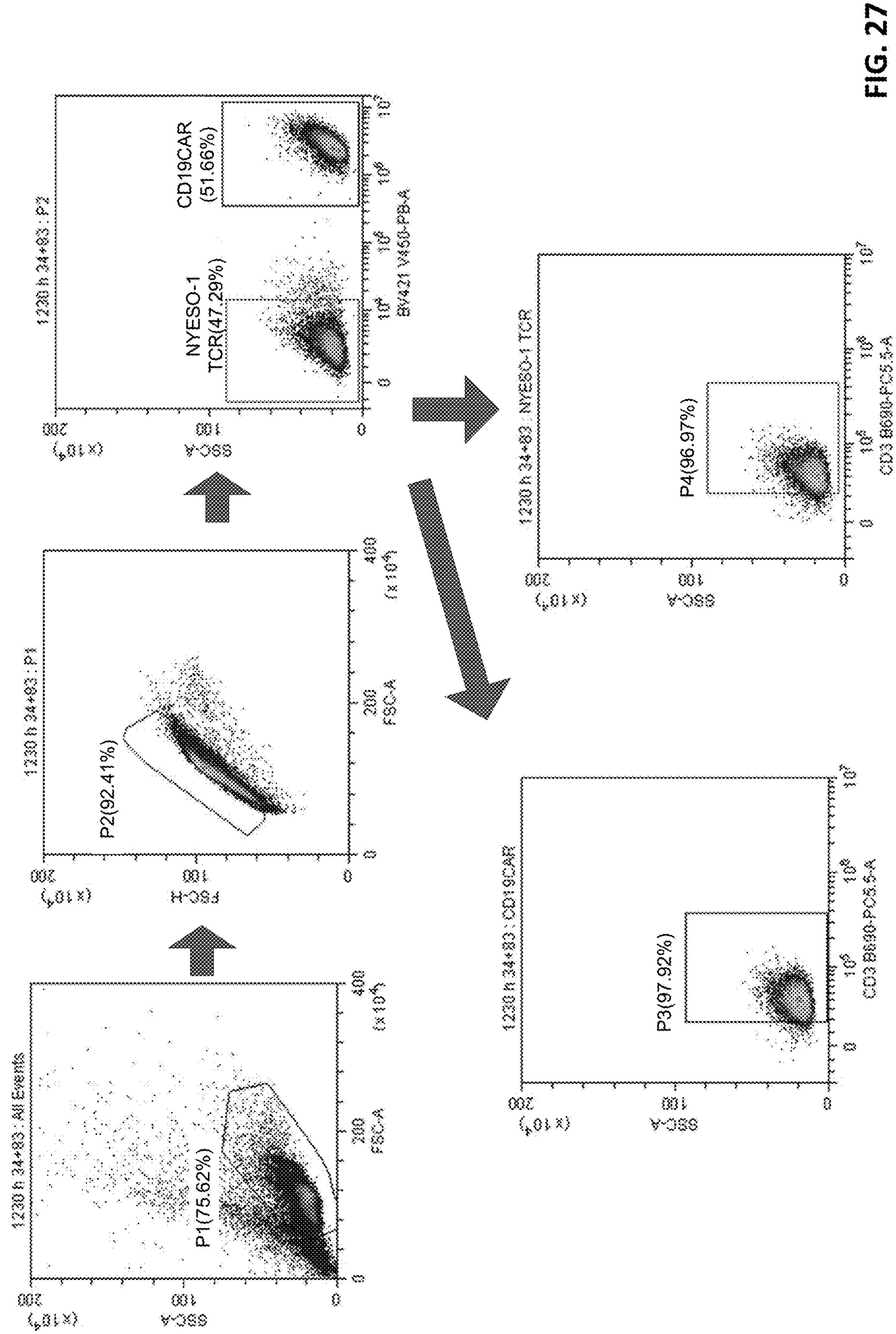
FIG. 27 shows the identification of co-cultured cells using flow cytometry.

FIG. 27 shows the identification of co-cultured cells using flow cytometry. In order to distinguish the two kinds of T cells after co-culturing, CD19 CAR cells were stained with VIOLET to be labeled with purple fluorescence. Cells were divided into two groups by flow cytometry V450-PB channel: the positive group was CD19 CAR cells, and the negative group was NYESO-1/AFP TCRTS (C). The CD3 positive population was the T cell.

Figure 28:
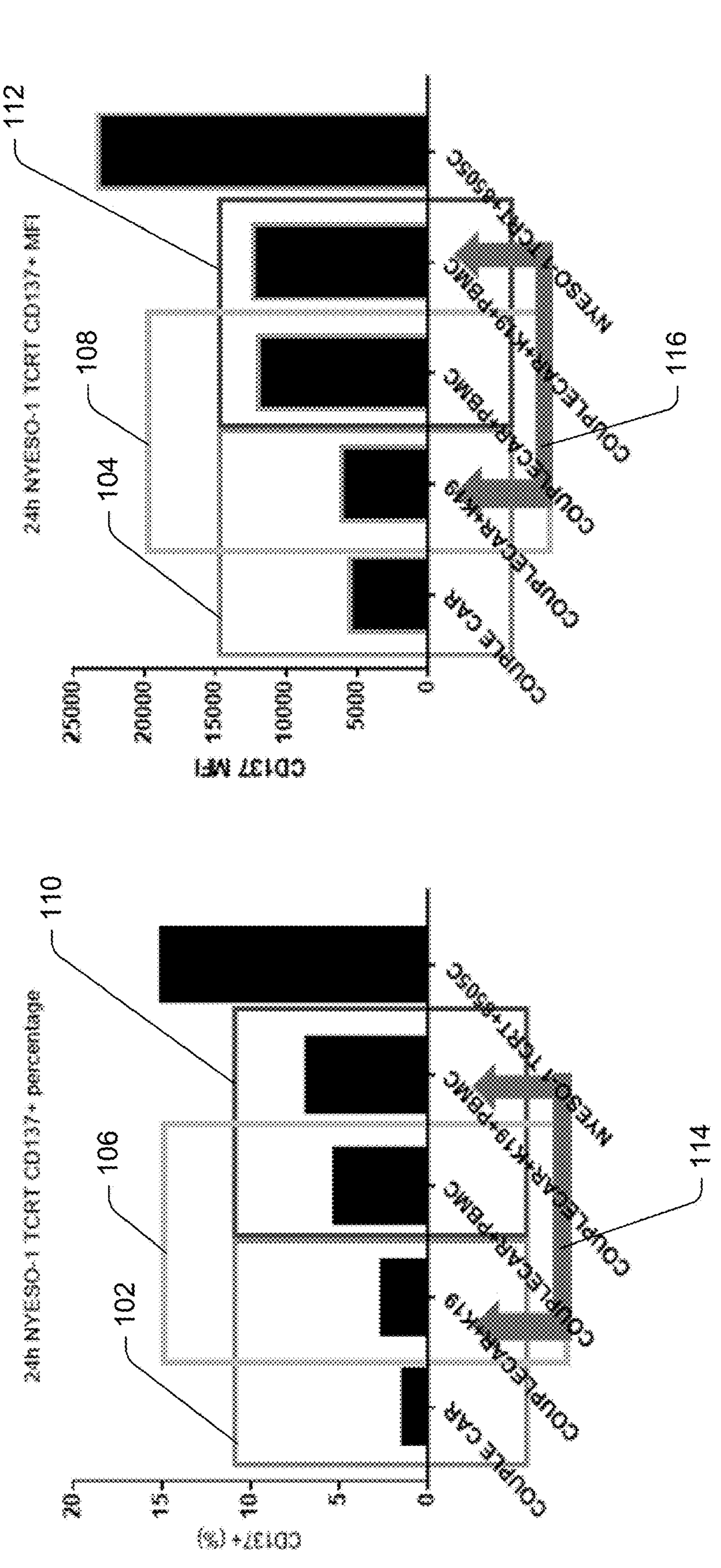
FIG. 28 shows results of flow cytometry analysis on activation of co-cultured cells including CD19 CART cells and NYESO-1 TCRTS. Arrows 114 and 116 as well as boxes 102, 104, 106, and 108 refer to comparison groups.

FIG. 28 shows results of flow cytometry analysis on activation of co-cultured cells including CD19 CAR T cells and NYESO-1 TCRTS. Various groups of cells were co-cultured for 24 hours, and activation of these cells was measured using flow cytometry. The activation of NYESO-1 TCRTS was very low in the control group NC (1.43% MFI=5559). The activation of NYESO-1 TCRTS in the PC group was normally (15.02%, MFI=23301). The activation of NYESO-1 TCRTS in group A (2.56%, MFI=6087) was higher than that in NC group (See 102 and 104). The activation of NYESO-1 TCRTS in group B (5.28%, MFI=12352) was higher than that of group A (2.56%, MFI=6087) (See 106 and 108). The activation of NYESO-1 TCRTS in group C (6.80%, MFI=12352) was higher than that in group B (5.28%, MFI=12352) (See 110 and 112). The activation of NYESO-1 TCRTS in group C was higher than in group A (See 114 and 116).

Figure 29:
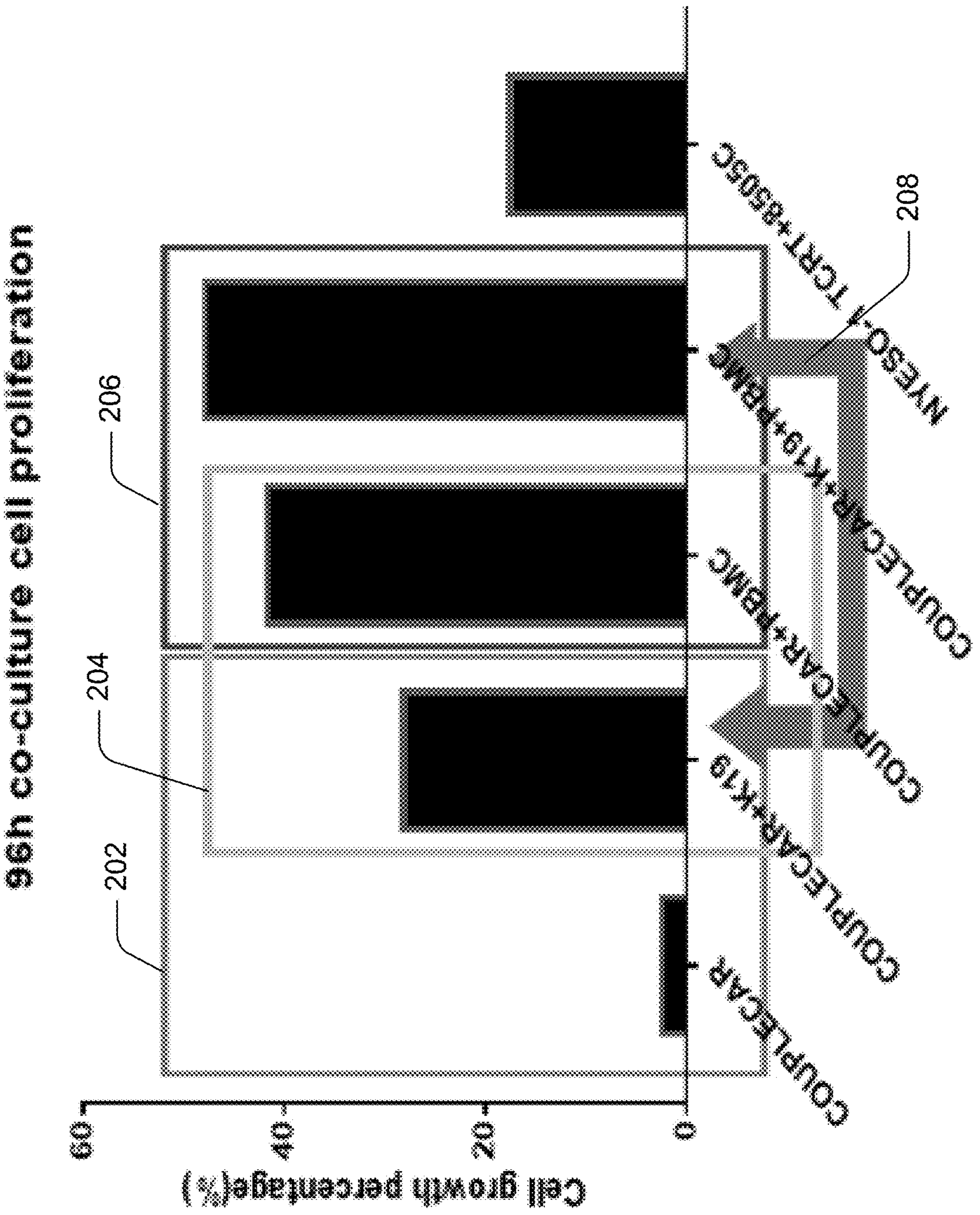
FIG. 29 show results of flow cytometry analysis on the proliferation of co-cultured cells including CD19 CART cells and NYESO-1 TCRTS. Arrow 208 as well as boxes 202, 204, and 206 refer to comparison groups.

FIG. 29 show results of flow cytometry analysis on the proliferation of co-cultured cells including CD19 CAR T cells and NYESO-1 TCRTS. Various groups of cells were co-cultured for 96 hours, and the proliferation of these cells was measured using flow cytometry. A comparison of cell proliferation was performed. The proliferation of NYESO-1 TCRTS cells in the NC control group was 2.46%. The proliferation of NYESO-1 TCRTS cells in group A was 28.17%, which was increased compared to the NC group (See 202). The proliferation of NYESO-1 TCRTS cells of group B was 41.60% higher than group A (See 204). The proliferation of NYESO-1 TCRTS cells of group C was 47.79%, which was higher than that of group B 41.60% (206) and higher than that of group A (See 208).

Figure 30:
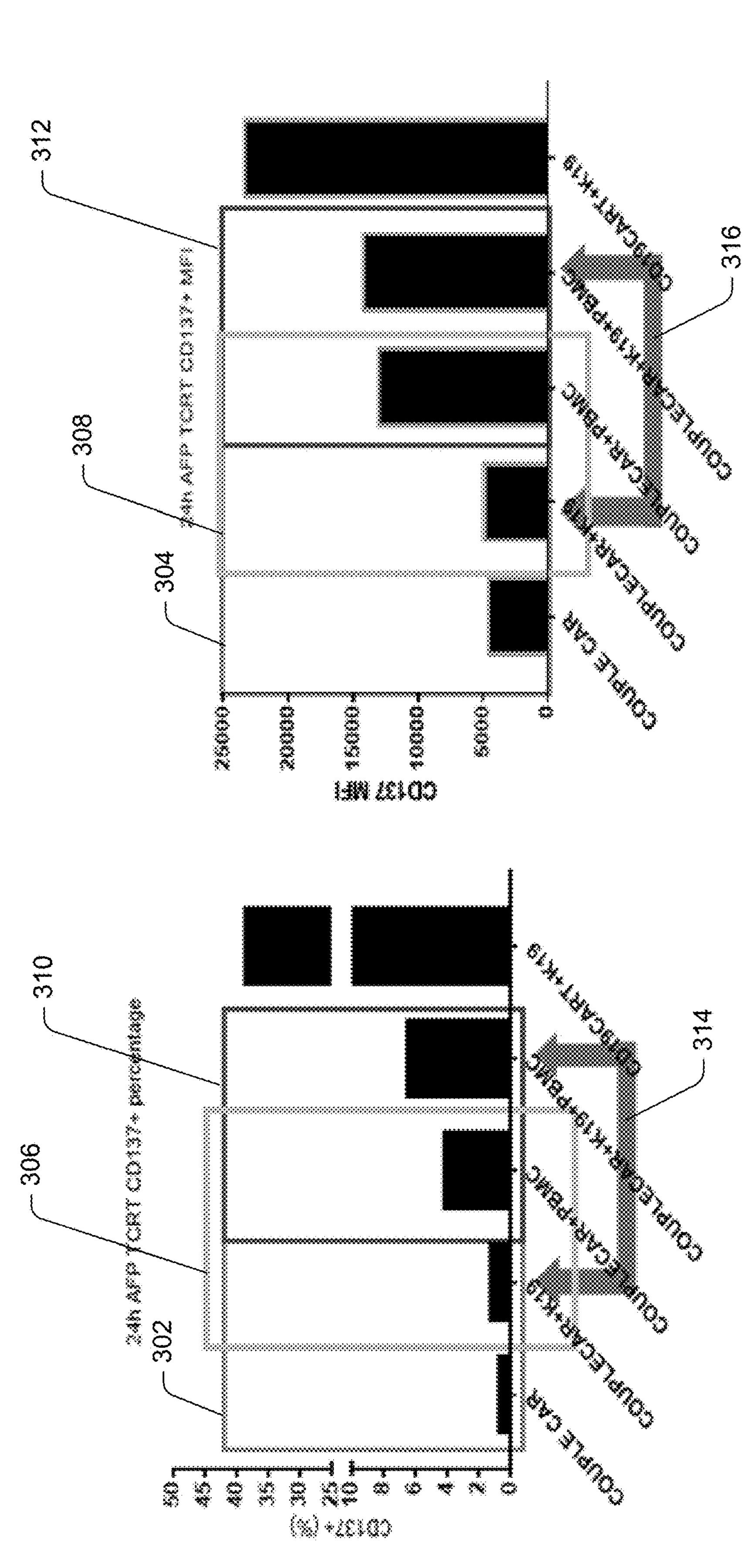
FIG. 30 show results of flow cytometry analysis on activation of co-cultured cells including CD19 CART cells and AFP TCRTS. Arrows 314 and 316 as well as boxes 302, 304, 306, and 308 refer to comparison groups.

FIG. 30 show results of flow cytometry analysis on activation of co-cultured cells including CD19 CAR T cells and AFP TCRTS. Various groups of cells were co-cultured for 24 hours, and activation of these cells was measured using flow cytometry. The AFP TCRTS of the control group NC was not activated (0.70% MFI=4568). The activation of AFP TCRTS of PC group was normally (38.58%, MFI=23327). The activation of AFP TCRTS of group A (1.24%, MFI=4884) was higher than that of NC group (See 302 and 304). The activation of AFP TCRTS of group B (4.17%, MFI=13112) was higher than that of group A (1.24%, MFI=4884) (see 306 and 308). The activation of AFP TCRTS of group C (6.47%, MFI=14218) was higher than that in group B (4.17%, MFI=13112) (see 310 and 312) and was higher than that in group A (see 314 and 316). In addition, TCR negative T cells were also partially activated (NC=0.51%; A=1.46%; B=2.84%; C=5.12%). The relationship among the groups was the same as that of the positive part.

Figure 31:
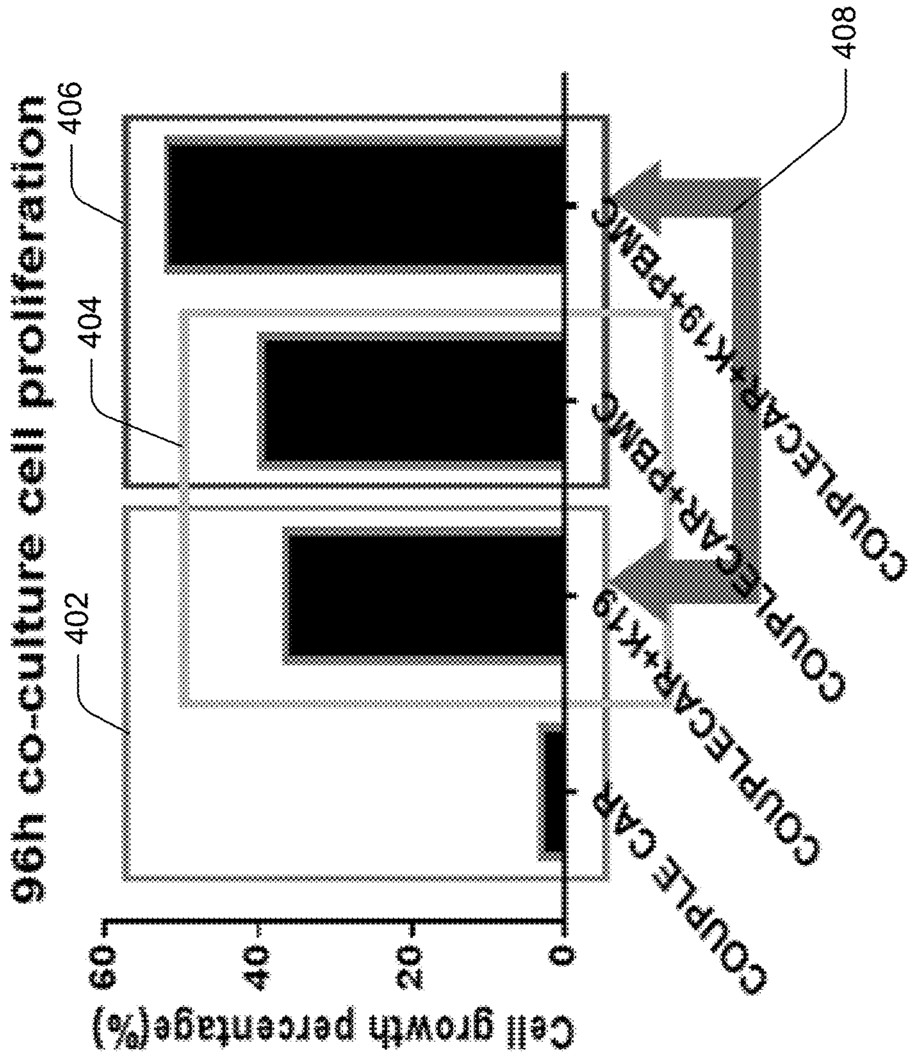
FIG. 31 show results of flow cytometry analysis on the proliferation of co-cultured cells including CD19 CART cells and AFP TCRTS. Arrow 408 as well as boxes 402, 404, and 406 refer to comparison groups.

FIG. 31 shows results of flow cytometry analysis on the proliferation of co-cultured cells including CD19 CAR T cells and AFP TCRTS. Various groups of cells were co-cultured for 96 hours, and activation of these cells was measured using flow cytometry. A comparison of cell proliferation was performed. The proliferation rate of AFP TCRTS of the NC control group was 3.11%. The proliferation rate of AFP TCRTS of group A was 36.44%, which was increased compared to NC group (402). The proliferation rate of AFP TCRTS of group B was 39.59%, which was higher than 36.44% of group A (404). The proliferation rate of AFP TCRTS of group C was 51.97%, which was higher than 39.59% (406) in group B and higher than group A (408). Thus, CD19 CAR T cells enhance TCRT cells' expansion by increasing their proliferation rates.

These data show that the activated first type of CAR T cells can activate the second type of CART cells in coupled CART cells (e.g., CD19 CART cells and CLDN18.2 CAR T cells). For example, the activated first type of CAR T cells enhanced the activation, cytokine releases, and cell proliferation of the second type of CAR T cells. This effect was enhanced when PBMC was present. Given that PBMC and monocytes were activated, the first type of CAR T cells can activate monocytes (e.g., DCs), which can then activate the second type of CAR T cells. The combination of the data presented here and the data shown in the in vivo Examples of the present disclosure shows that subjects' dendritic cells (DCs) work as a medium to associate the activation of the first type of CAR T cells with the activation of the second type of CAR T cells and form a positive circle of activations, which may contribute to the expansion of CAR T cells observed in the subjects (Patients 004-011) due to amplification of immune homeostasis. These data and the clinical data above indicate that coupled or mixed T cells achieve enhanced T cell response including the expansion of T cells and/or cytokine release. Examples of the coupled or mixed T cells include BCMA and GUCY2C CART cells as well as CD19 CART cells and NYESO-1 TCRTS. After infusion of the mixed T cells to patients, a first group of T cells (e.g., CD19 and BCMA CART cells) bind an antigen of B cells and are activated. After their activation, the first group of CAR T cells up-regulates certain membrane molecules (e.g., CD28, OX40, 4-1BB, CD40L, etc.) and release certain cytokines (e.g., IFNγ and GM-CSF). These surface molecules and cytokines activate and/or recruit cells such as monocytes (e.g. DCs) and neutrophils. The recruited and/or activated cells release cytokines (e.g., TNFα, IL6, IL12) to form an inflammatory-like environment. In light of the inflammatory-like environment, these activated immune cells up-regulate some proteins (e.g., CD80, CD80, and CD40), which activate a second group of T cells (e.g., NT, CART cells targeting solid tumors, and NYESO-1 TCRTS). Also, cytokines (e.g., IFNγ) secreted by the first group of T cells also activate the second group of T cells.

In vivo Cytokine Release Using Antigen Presenting Cells

Figure 35:
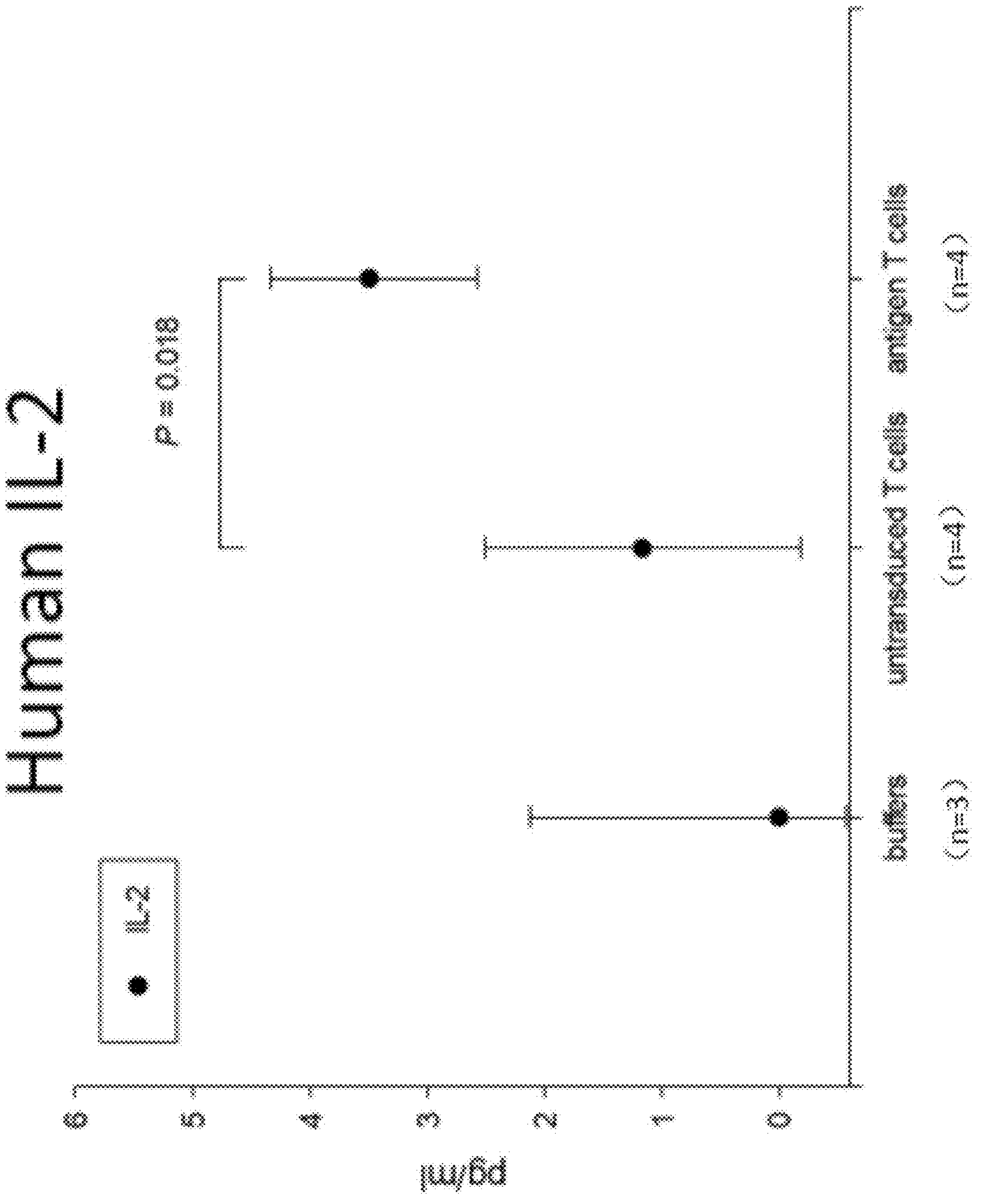
FIG. 35 shows cytokine release (IL-2) in mouse peripheral blood.
Figure 36:
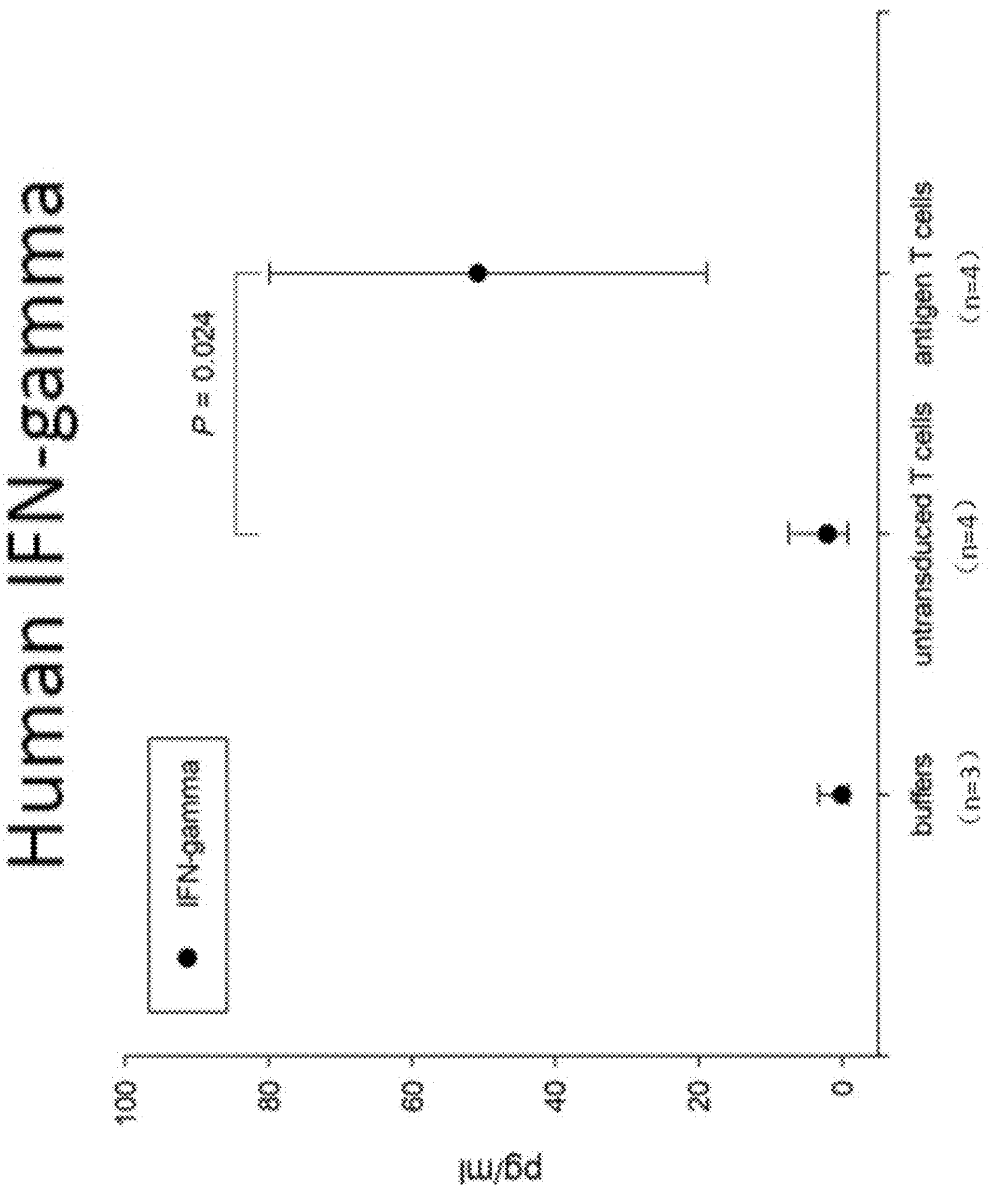
FIG. 36 shows cytokine release (IFN-gamma, IFNγ, or IFNg) in mouse peripheral blood.
Figure 37:
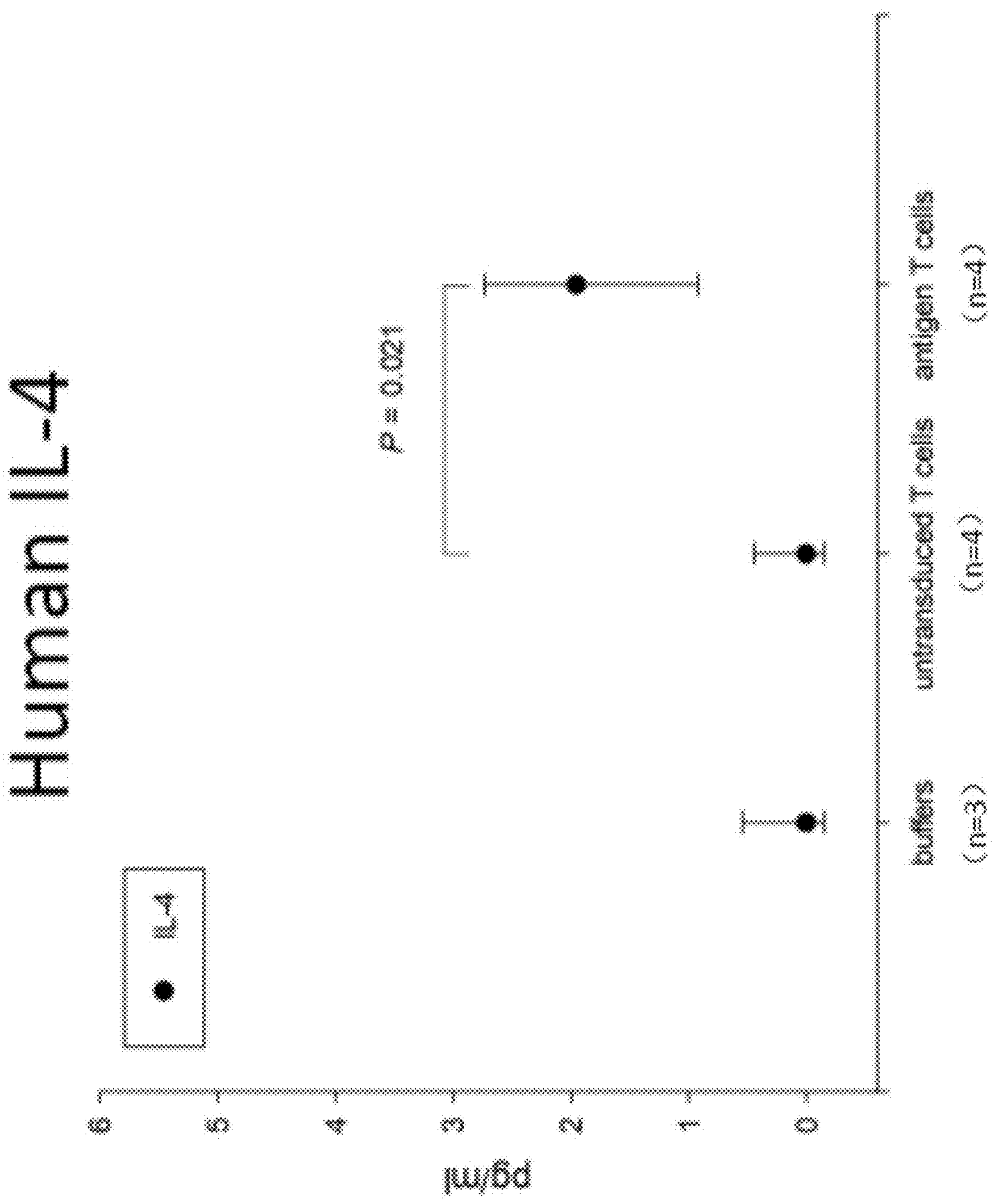
FIG. 37 shows cytokine release (IL-4) in mouse peripheral blood.

Primary T cells of Group 1 and Group 2 were infused into mice (Experimental Group). As control, Primary T cells of Group 1 alone or buffer were infused into mice (Control Group 1 and Control Group 2). Several parameters regarding cell infusion are provided in Table 8 below. NPG mice were irradiated, and a certain number of CAR T cells and corresponding control agents were infused into mice. For Control Group 2, three consecutive buffers were returned to the mice. For Control Group 1, T cells that do not express antigen were returned three times in succession. For Experimental Group, T cells expressing antigens were continuously transfused three times in succession. After the transfusion was completed, blood from the limbal vein was collected to analyze the T cells and factor release in the peripheral blood of the mice. The mice were then sacrificed and T ratios of each organ/CAR T Cell ratio/CAR T copy and other data were collected. Cytokine release assay was then performed. Various cytokines (e.g., IFNg, IL4, IL2) in mice peripheral blood were measured for Experimental Group and Control Group. As shown in FIGS. 35-37, the amount of cytokine released in the Experimental Group was greater than those in Control Group. These results demonstrate that infusion of cells expressing an antigen enhance the T cell response of the corresponding CAR T cells. The schedule for in vivo analysis is provided in Table 9 below.

TABLE 8

| Experimental Group | Control Group 1 | Control Group 2 |
|---|---|---|
| TSHR CAR T cells about 4 × $10^6$/mouse Antigen T (TSHR-overexpressed T cell) about 4 × $10^6$/mouse per time | TSHR CAR T cells about 4 × $10^6$/mouse NT (non-transduced T cell) about 4 × $10^6$/mouse per time | TSHR CAR T cells about 4 × $10^6$/mouse NT (non-transduced T cell) about 4 × $10^6$/mouse per time |

TABLE 9

| Day 1 | Day 3 | Day 5 | Day 9 | Day 12 | Day 14 | Day 21 | Day 28 |
|---|---|---|---|---|---|---|---|
| irradiation at 1.5 Gy | TSHR CAR T cells infusion | buffers/nt/antigen T infusion | buffers/nt/antigen T infusion | buffers/nt/antigen T infusion | bleeding and analysis | bleeding and analysis | sacrifice and analysis |

As described above, the treatment methods described herein can easily be adapted for other species or subjects, such as humans.

Signaling Involved in CoupledCAR®

Figure 38:
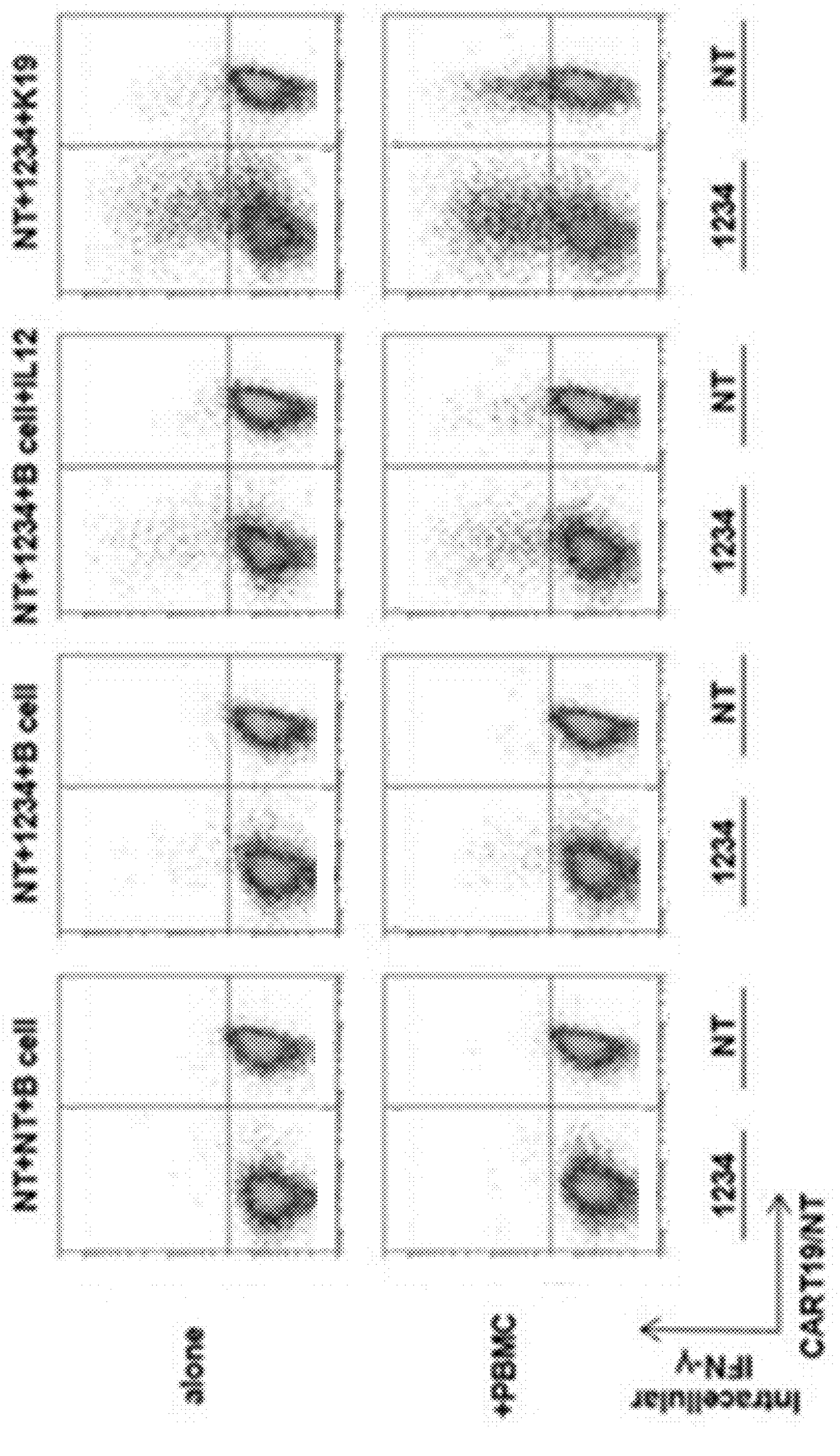
FIG. 38 shows flow cytometry results of different T cells cocultured with substrate cells.

FIG. 38 shows flow cytometry results of different T cells cocultured with substrate cells. Compared with K19 and N6 (CD19 positive cells), B cells caused activation of both CD19 CAR T (directly) and solid tumor CAR T cells (indirectly), and decreased release of IL-2 and IFNγ. By controlling the same number of tumor cells and B cells, the amplification of solid tumor CAR T cells or NT was higher than that caused by K19 cells. It was also observed that cytokine release and activation were higher in CD19 CAR treating ALL than killing normal B cells. These results indicate that B cells (CD19 positive cells) can activate CD19 CAR directly and activate NK and other T cells indirectly.

It has been found that in the presence of PBMC monocytes, enhanced cytokine release and cell expansion of T cells including CD19 CART cells and CART cells targeting solid tumor antigens. It was further observed that the monocytes in PBMC expressed CD86/CD80, which corresponds to CD28 costimulatory signaling on T cells. After the mixed CART cells (CD19 CART cells and TSRH or GCC CART cells) were mixed with K19 cells, a significant amount of IL2 was released. Activation of CAR T cells and non-CAR T cells up-regulated CD40, which is a costimulatory ligand. After IL12 was added, CD40L was further up-regulated in non-CAR T cells. It has been known that CD40-CD40L was involved in activation of monocytes, macrophages, DC and B cells. These results indicate that the presence of PBMC can enhance cytokine release and cell expansion of the mixed CART cells via CD40-CD40L signaling. Thus, enhanced CD40-CD40L signaling can help CoupledCAR® to expand T cells.

Figure 39:
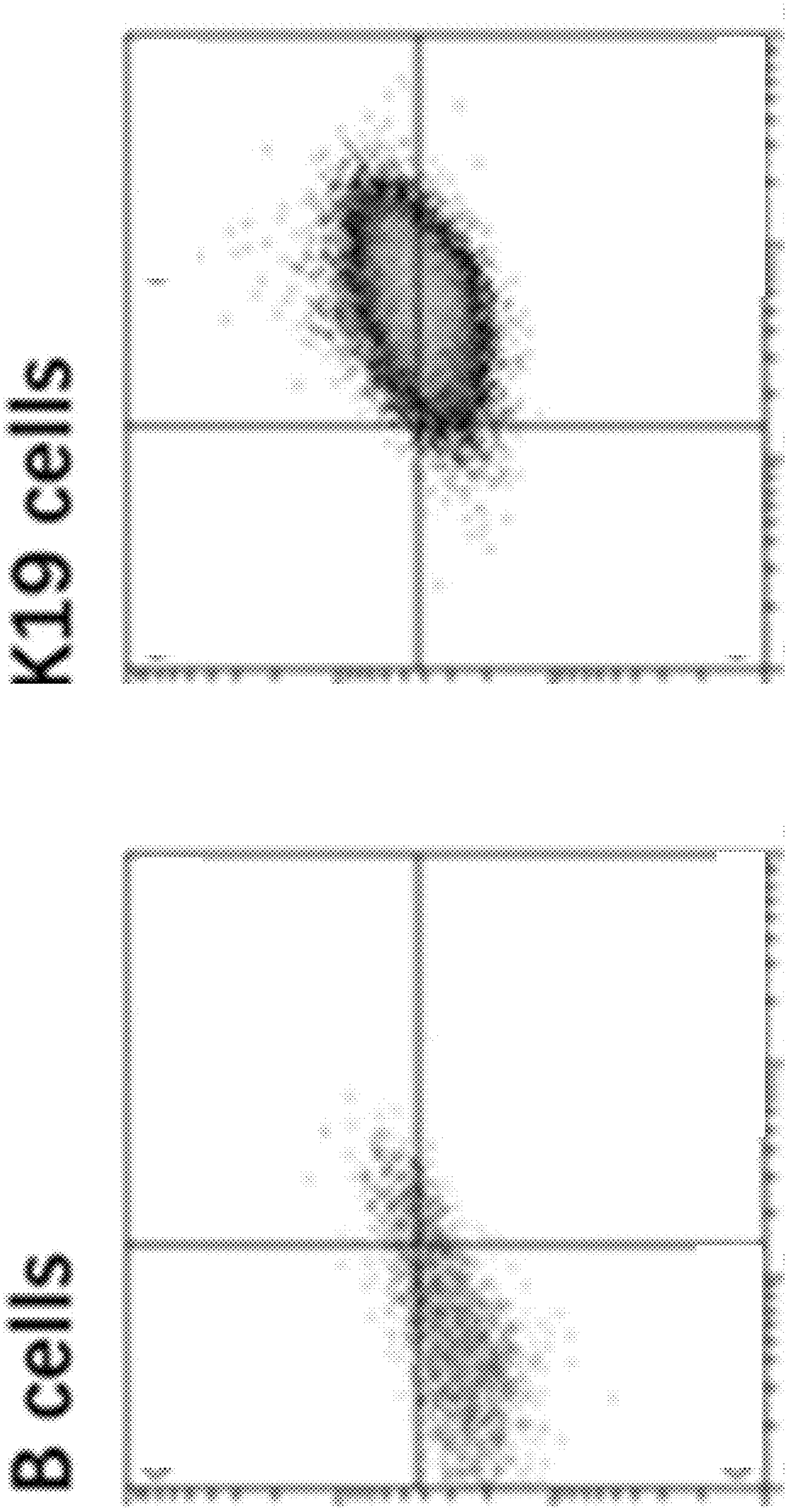
FIG. 39 shows flow cytometry results of B cells and K562-19 (K19) cells in the coculturing of FIG. 19.
Figure 40:
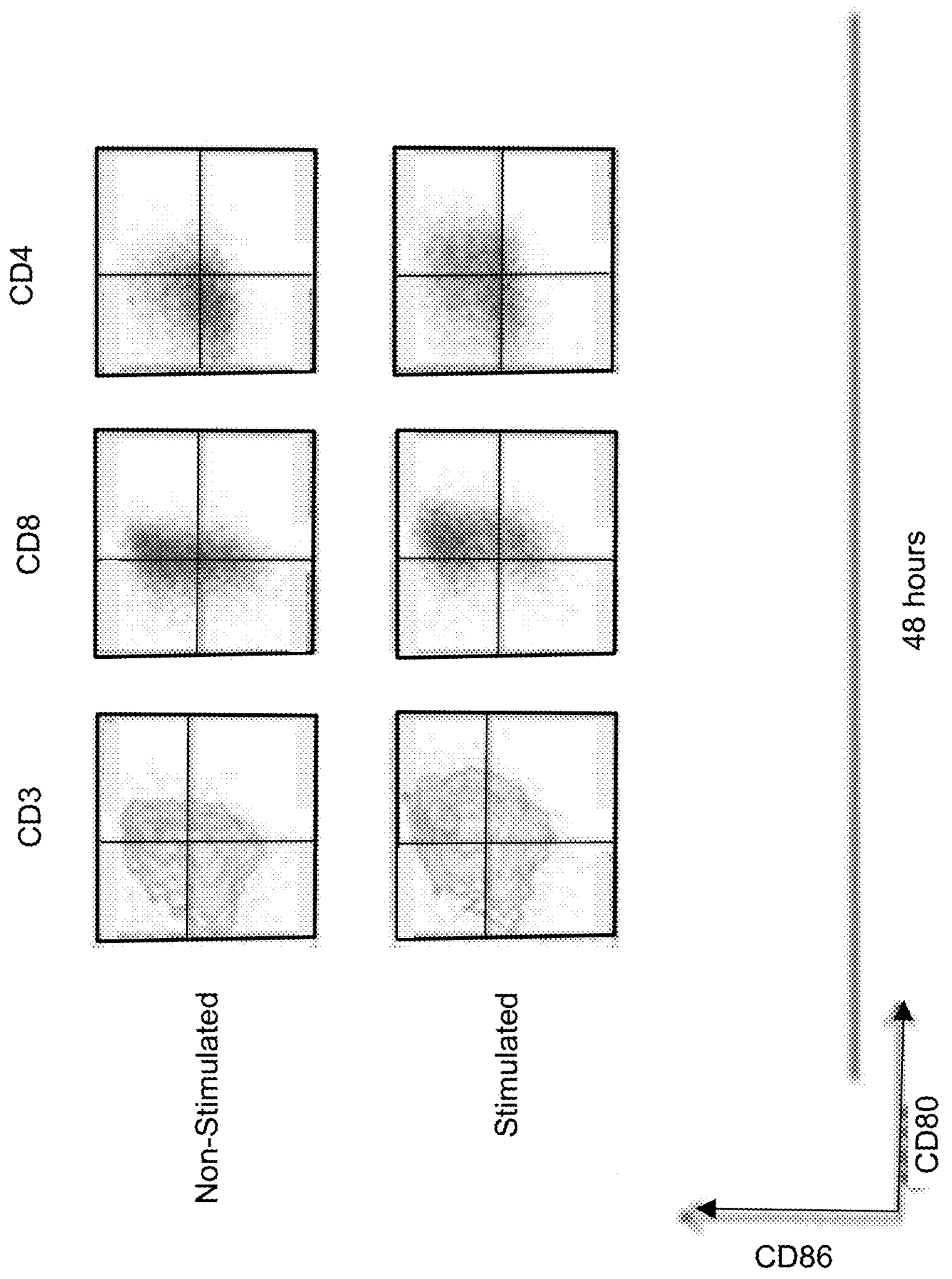
FIG. 40 shows flow cytometry results of protein expression of stimulated T cells and non-stimulated T cells.
Figure 41:
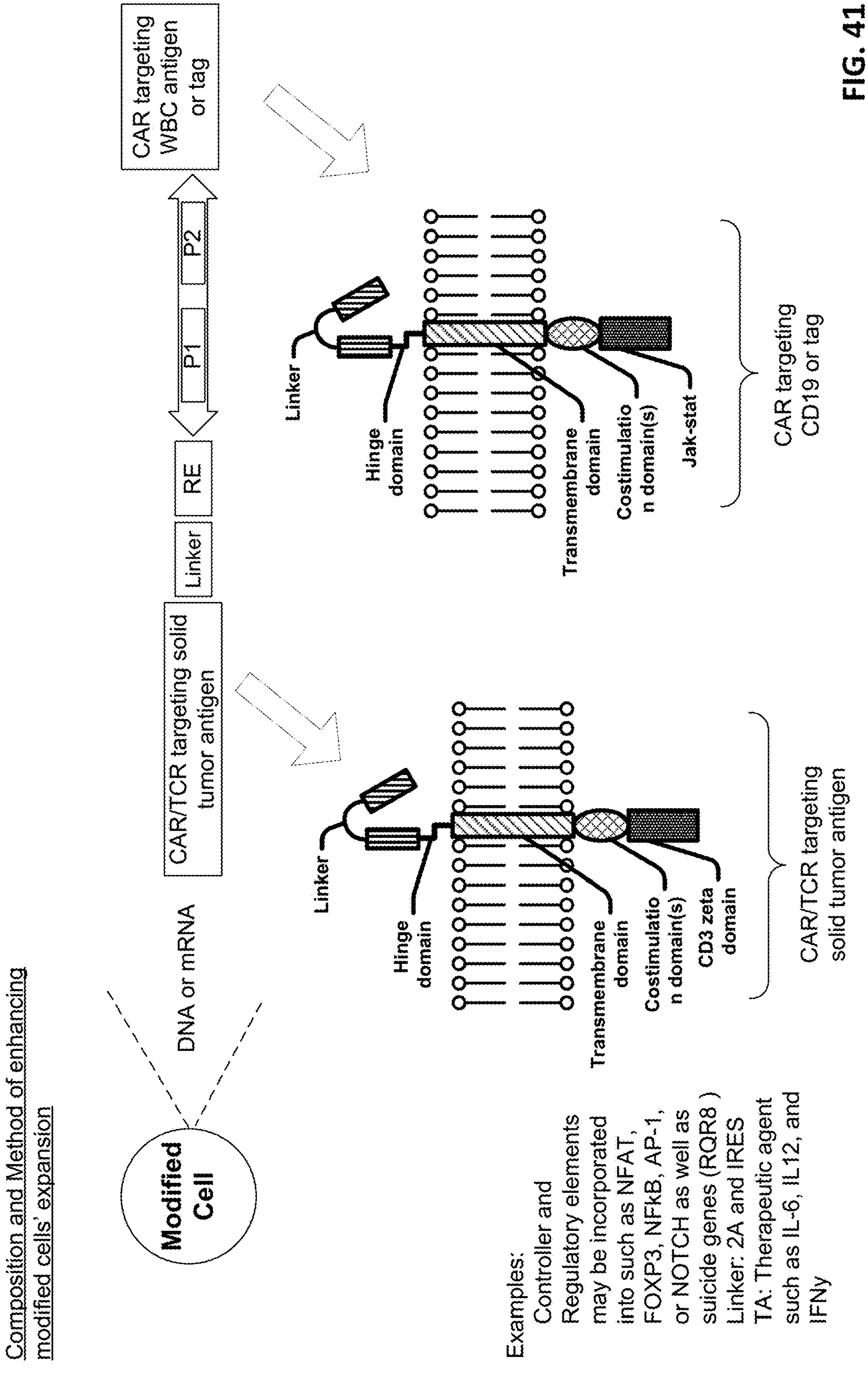
FIGS. 41, 42, 43, 44, 45, 46, and 47 show various embodiments that enhance cell expansion in a subject (in vivo).
Figure 42:
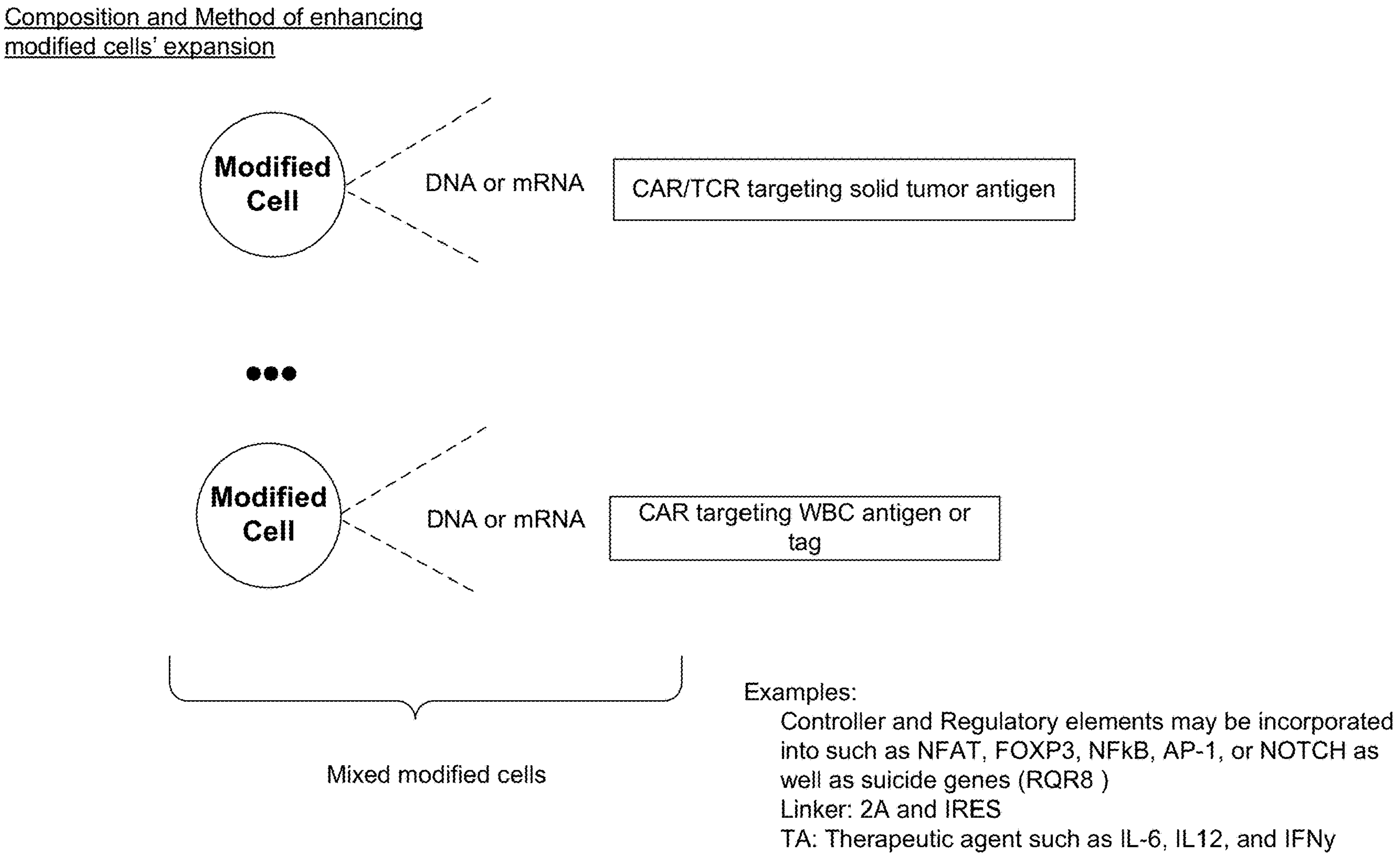
Figure 43:
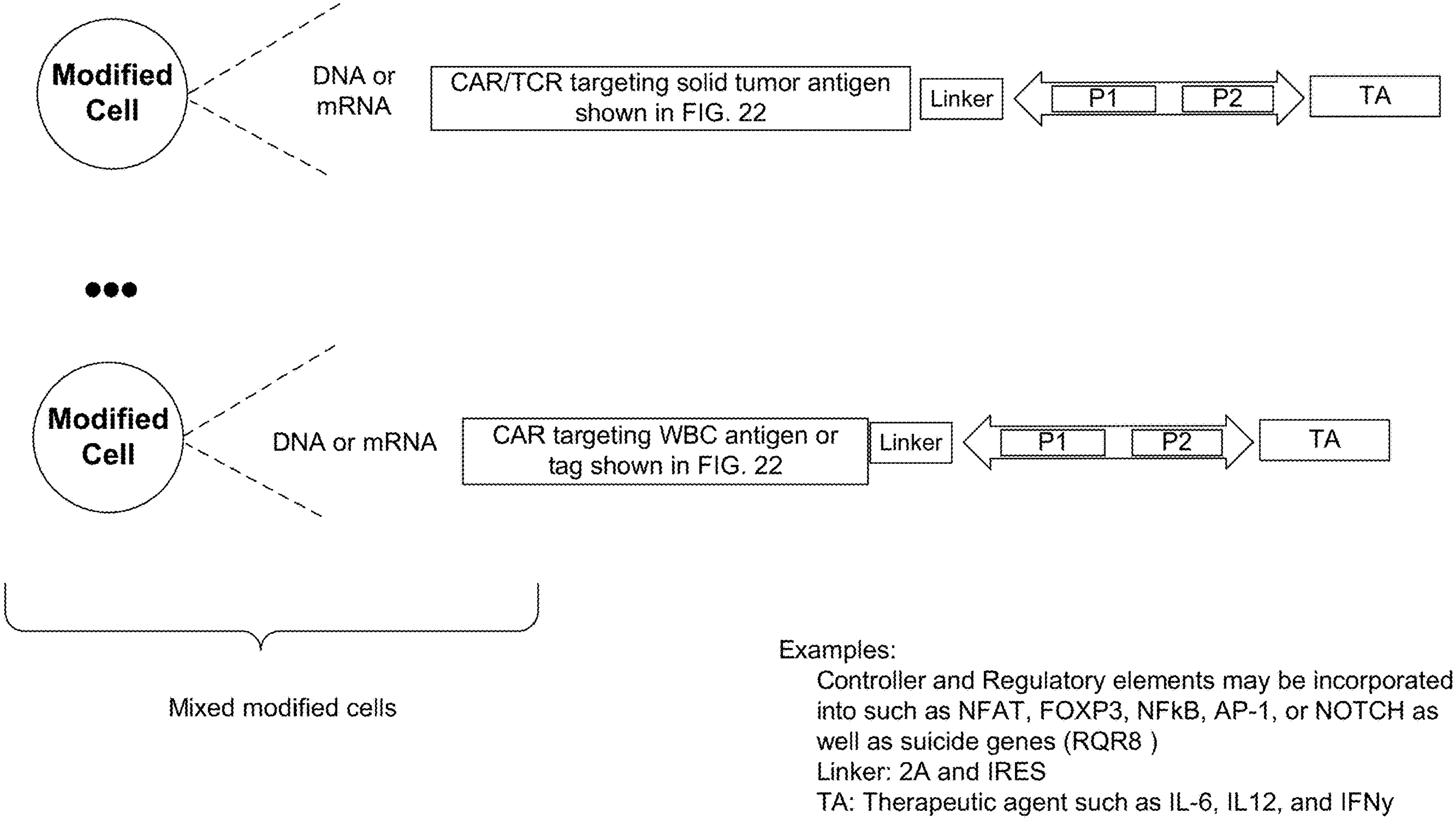

FIG. 39 shows flow cytometry results of B cells and K562-19 cells in the coculturing experiment of FIG. 19. As compared with B cells, K19 cells expressed higher CD80/CD86. FIG. 40 shows flow cytometry results of protein expression of stimulated T cells and non-stimulated T cells. Mixed CAR T cells without being activated by DynaBeads or transact solution showed little coupling relationship between CD19 CART cells and solid tumor CART cells (Coupled CAR T cells). As compared with a low concentration of IL2 stimulation, coupled CAR T cells, even without substate cells, grew faster than individual CAR T cells (CD19 CAR T cells or solid tumor CAR T cells) using the same IL2 concentration group, especially in CD4+ cells. In the CoupledCAR® group, CD8+/CD4+ cells expressed higher CD25, which is the IL2 receptor. Under this condition, T cells expressed higher CD80/CD86. It has been known that CD80 is meaningful for keeping CD25, which is a receptor of IL2. These results indicate that the mixed CAR T cells may be coupled via the IL2 and CD25 signaling pathway.

Figure 44:
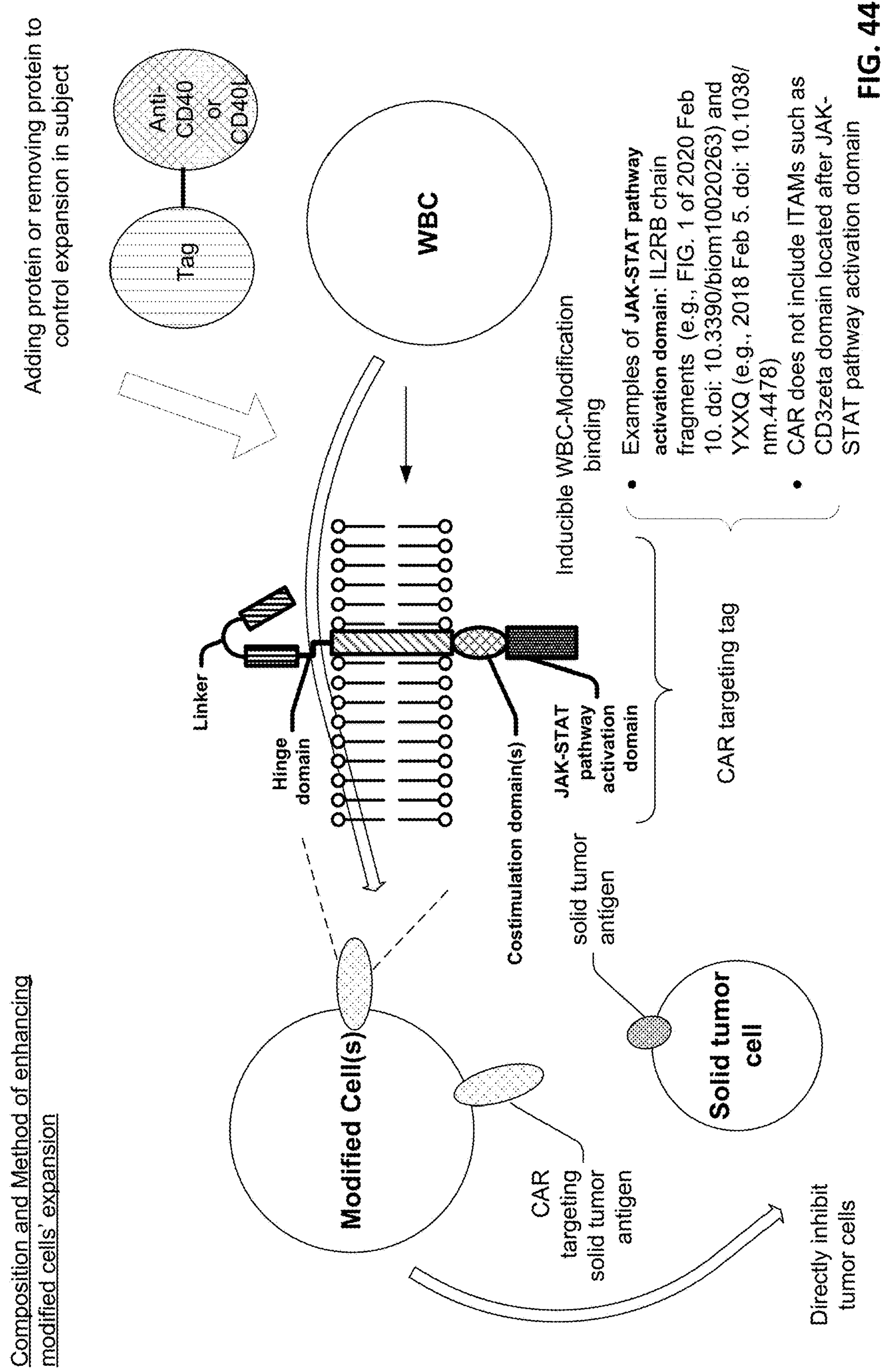
Figure 45:
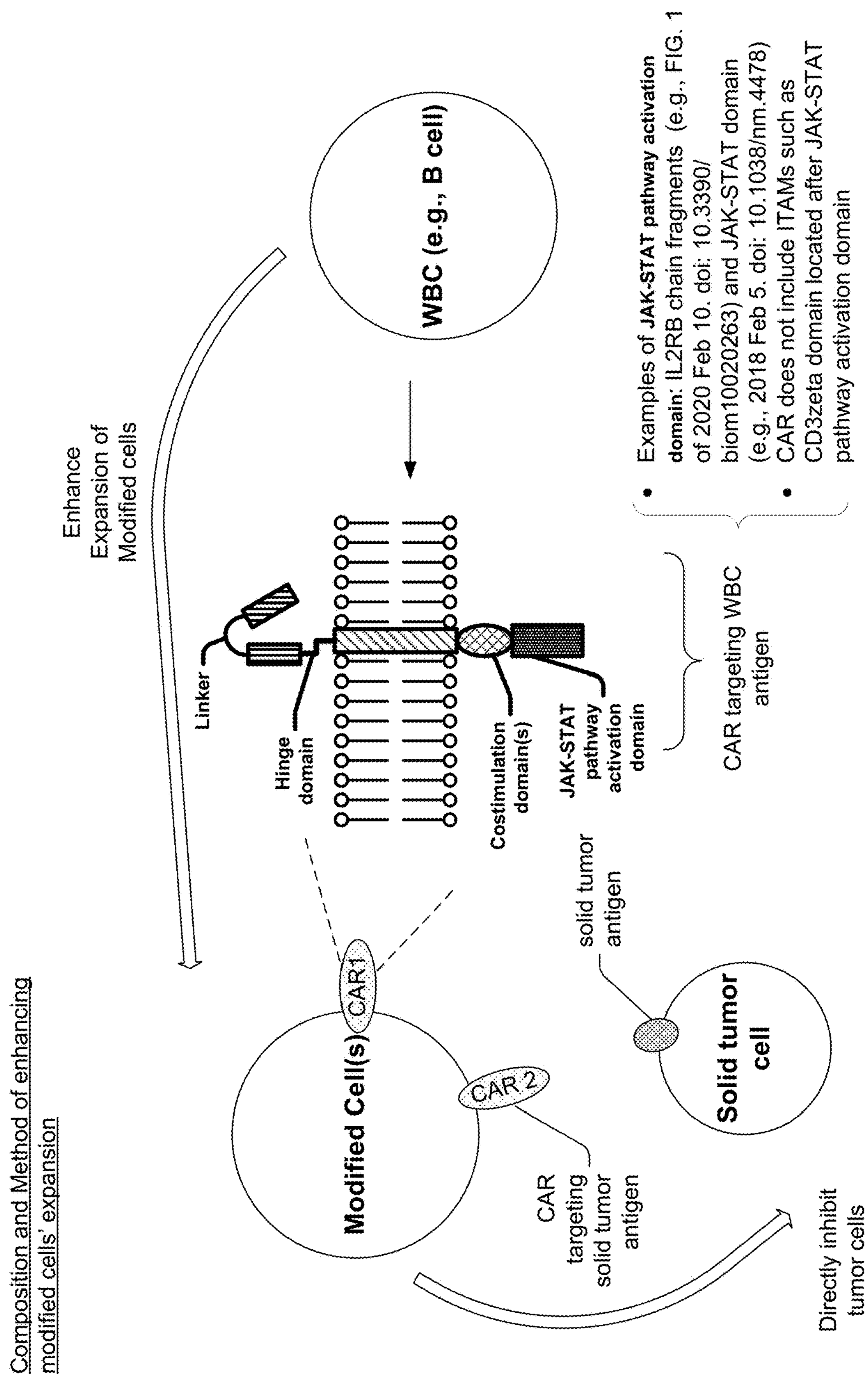
Figure 46:
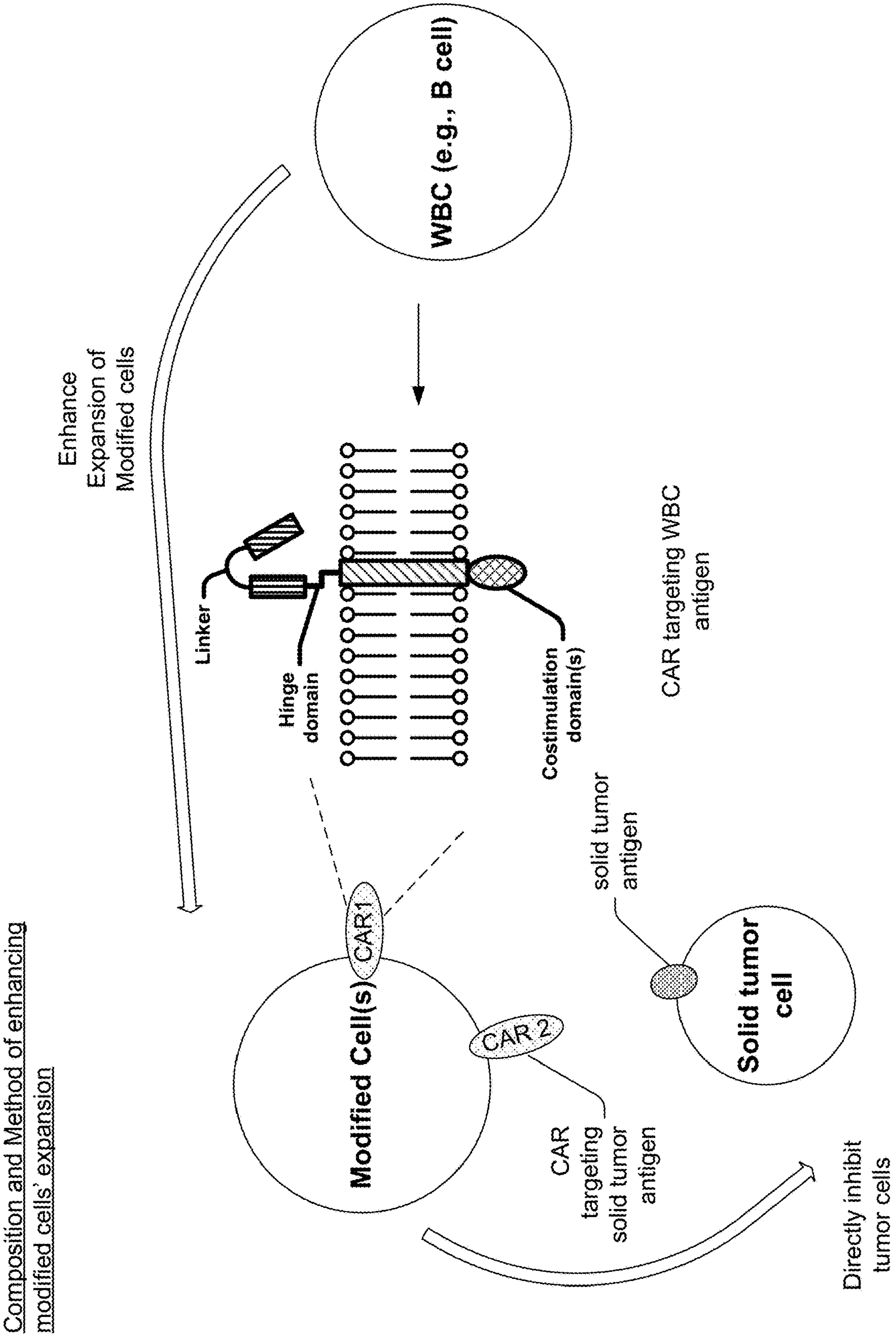
Figure 47:
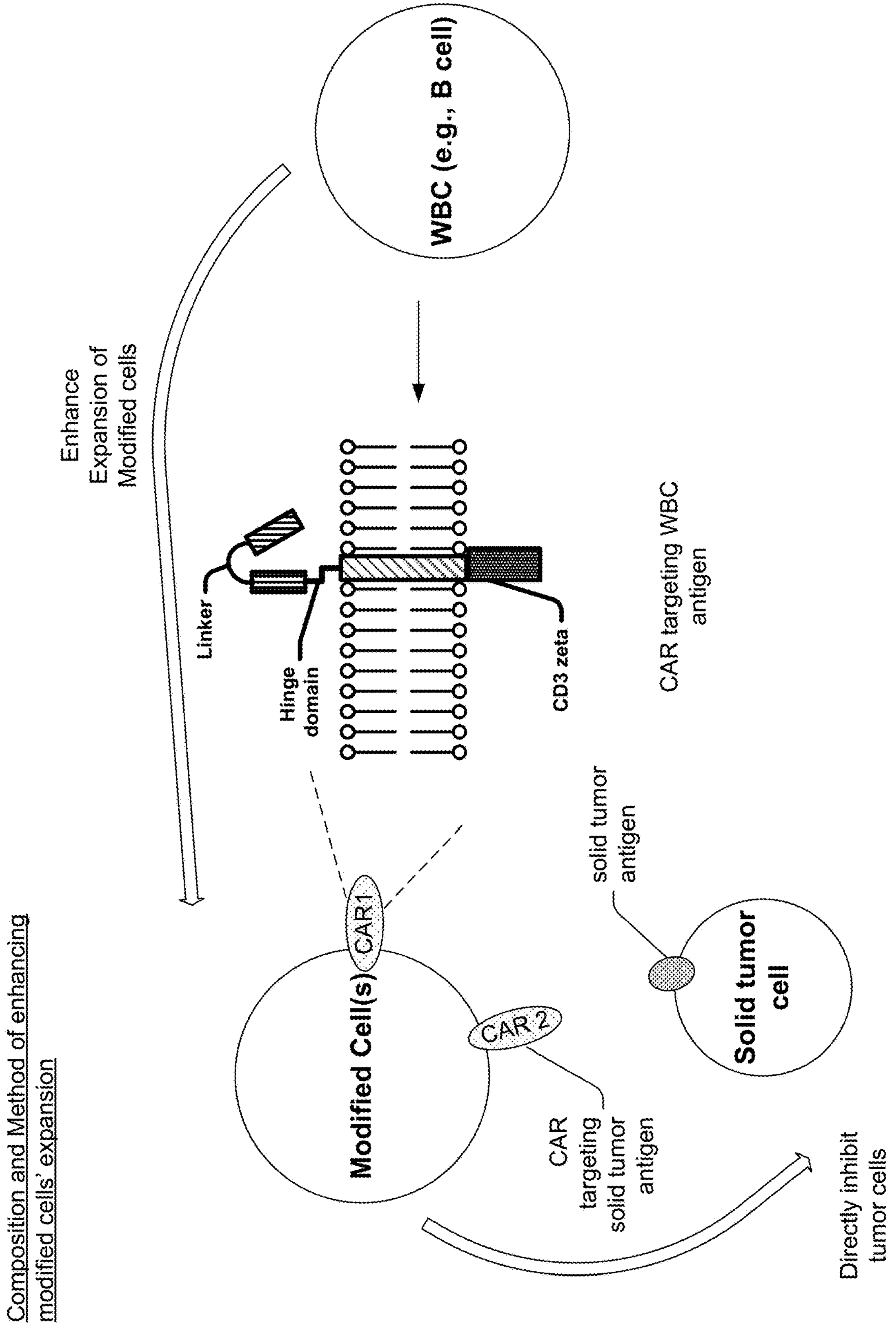

FIG. 41-47 show various embodiments that can enhance cell expansion in a subject (in vivo). In FIG. 44, modified cell recognizes the tag. After administering the Tag-Anti-CD40 drug to the subject, the CD40+ cells are activated and subsequently contact other T cells or modified T cells. The up-regulated CD80CD86 activates modified cells. Also, intracellular factor signals are activated to provide safety support. Due to the lack of CD3 zeta, NAFT would not be activated even in the presence of wnt5, and CD40+ cells would not be killed. After the drug is removed, the effect gradually wears off. In FIG. 45, CAR 1 recognizes CD19 and provides CD28 signaling as well as JAK-STAT signaling downstream of CD80/CD86. After contacting, for example, CD19, the expansion of the modified cells are enhanced without killing the WBC.

CoupledCAR®: Antigen-Independent Expansion Enhances Efficacy of CAR T Cells Against Solid Tumor CD19 CAR treatment of B cell malignancies have achieved very good curative effect, but the CAR T cell treatment of solid tumor has not been effective. Based on previous experience on both blood and solid tumor, we concluded that proliferation might be the key to overcome the problems treating solid tumors with standard CAR T. In previous multicenter clinical trial with CD19 CART for leukemia and lymphoma, it was unexpectedly found that not only did the CD19 CART cells proliferate, but the NT cells in the patients proliferated with the same trend. A CoupledCAR® system was designed to enable substantial expansion of solid tumor CAR T cells in antigen-independent manner, which was verified by an in vitro model and clinical trials. The proliferated solid tumor CAR T cells in the CoupledCAR® system were demonstrated to be independent of TCR signaling, and the cells achieved high proliferation with weak activation, no exhaustion and high memory related phenotype. More information of clinical trials can be found in WO2020106843 and WO2020146743, which are hereby incorporated by reference in their entirety.

Figure 48:
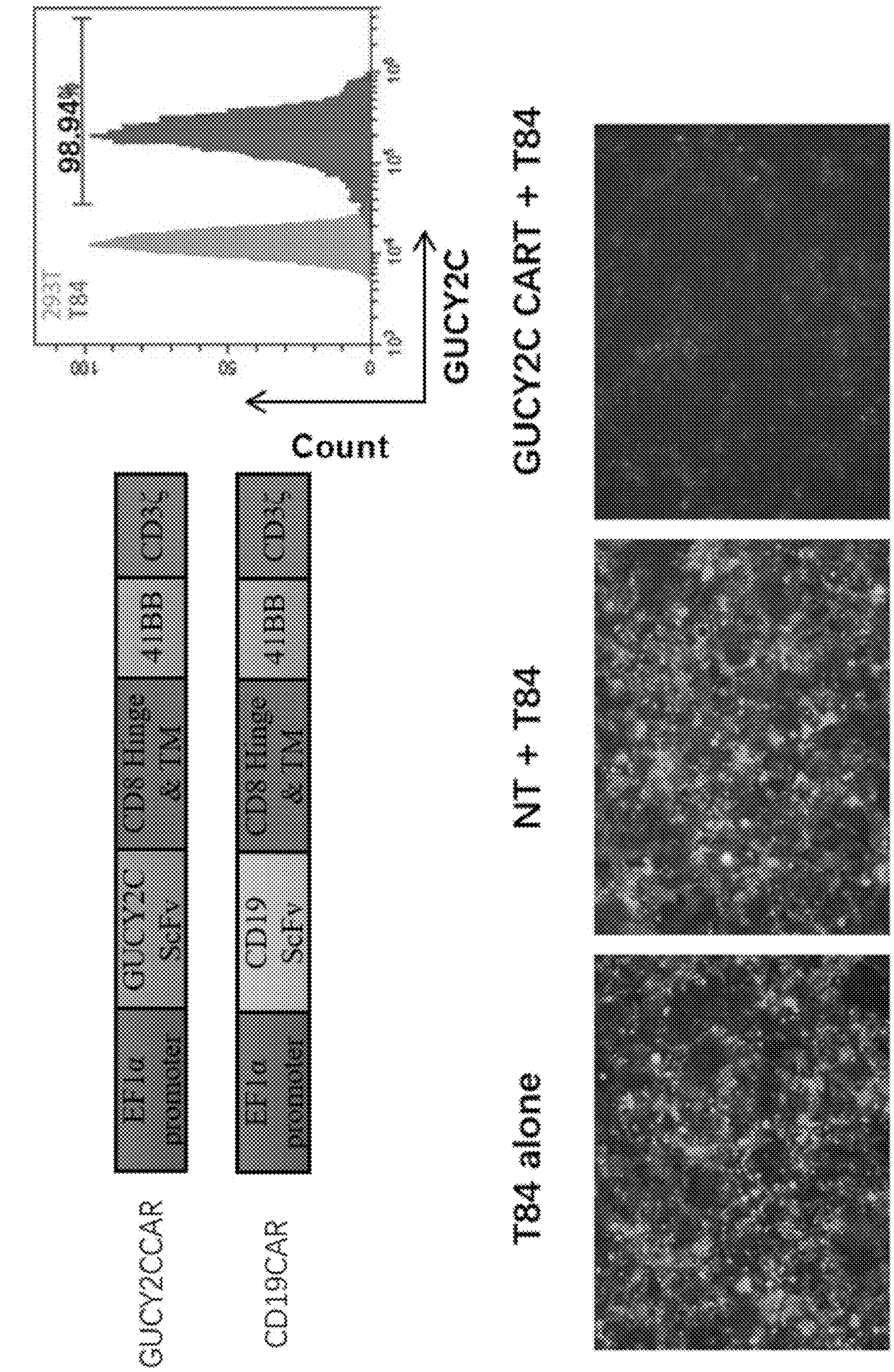
FIG. 48 shows the structure of GUCY2C CAR and the expression of GUCY2C on tumor cells (T84, human colorectal cancer cell line) and negative control cells (293T, human renal epithelial cell line).
Figure 49:
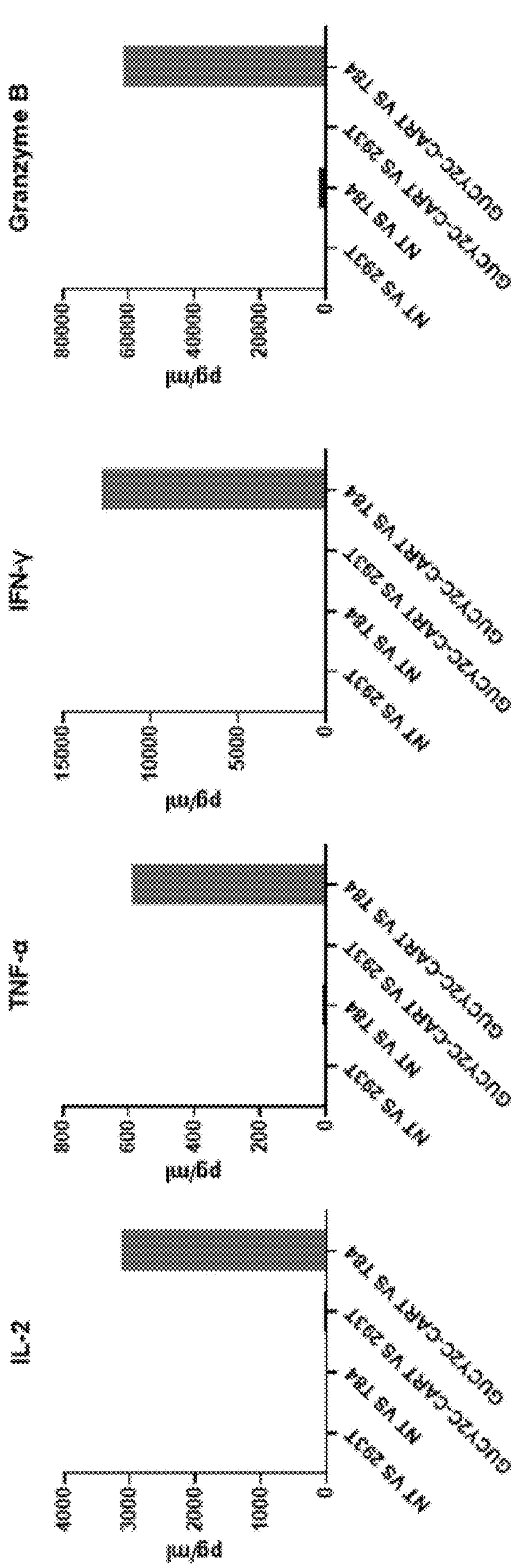
FIG. 49 shows the release of IL-2, TNF-α, IFN-γ (IFNγ) and granzyme B (gzmB) in the supernatant were detected by Cytometric Bead Array (CBA).

For hematologic malignancies, CAR T cells can rapidly proliferate by binding to ubiquitous antigens and execute their anti-tumor effects. Solid tumor CAR T cells can hardly get access to tumor sites due to surrounding obstacles. CoupledCAR® help solid tumor CAR T cells achieve high antigen-independent proliferation with weak activation, no exhaustion and high memory related phenotype outside tumor sites, thus they can easily infiltrate to eliminate tumor cells FIG. 48 shows the structure of GUCY2C CAR and the expression of GUCY2C on tumor cells (T84, human colorectal cancer cell line) and negative control cells (293T, human renal epithelial cell line). And after co-culture of CAR T cells with T84 cells and 293T cells. The results of fluorescence photography after co-culture of CAR T cells with tumor cells (100×). FIG. 49 shows the release of IL-2, TNF-α, IFN-γ and granzyme B (gzmB) in the supernatant were detected by Cytometric Bead Array (CBA). These results demonstrated that that GUCY2C CAR T cells can successfully kill GUCY2C-positive colorectal cancer tumor cells, and that CAR T cells can release effector molecules such as IL-2, TNF-α, IFN-γ and Granzyme B (gzmB) for killing target cells in an in vitro assay.

Figure 50:
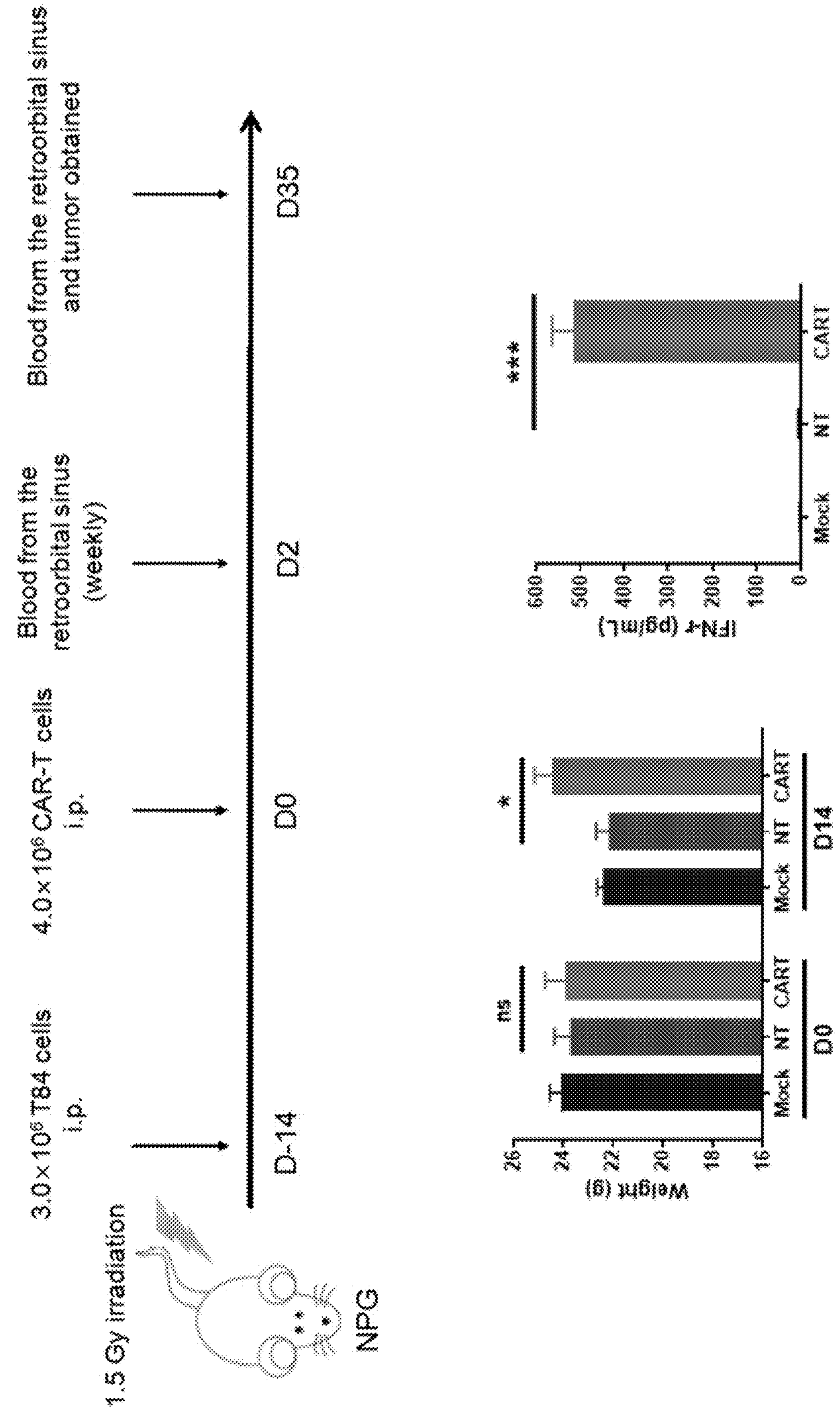
FIGS. 50 and 51 show in vivo experimental data of GUCY2C CAR targeting GUCY2C positive colorectal cancer. Mock is control, and NT is non-transduced.
Figure 51:
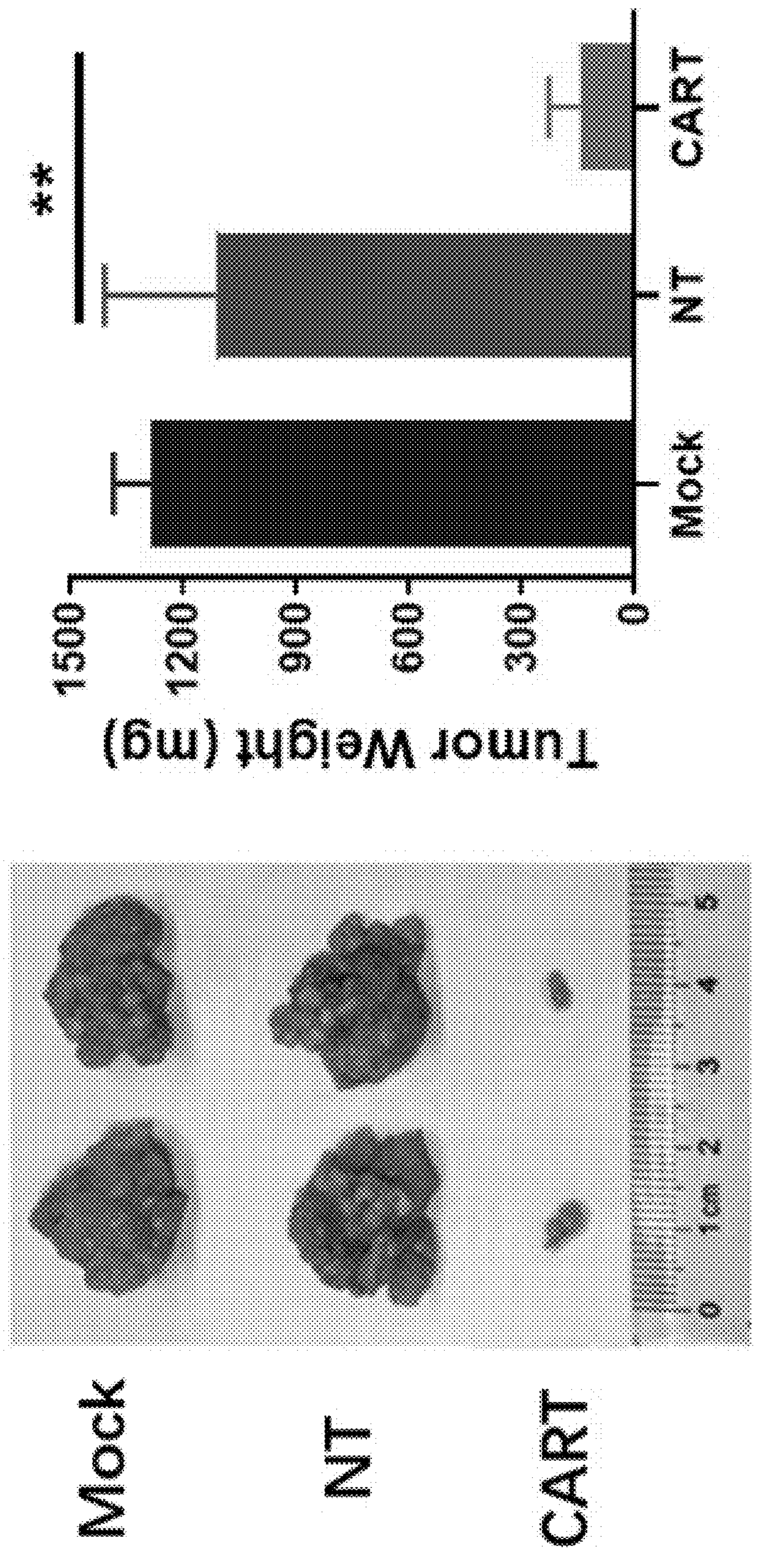

FIGS. 50 and 51 shows in vivo experimental data of GUCY2C CAR targeting GUCY2C positive colorectal cancer. FIG. 50 shows the experimental protocol and results. The experimental procedure the colorectal cancer model (D-14) was established by intraperitoneal injection of 3.0×10^6 T84 tumor cells. After 14 days (D0) $4.0\times10^6$ CAR T or NT cells were injected intraperitoneally for treatment(n=5). The blood was collected every week for flow cytometry. Mice were killed on D35 (Day 35) to extract tumor tissues. The change of body weight in each group is shown. FIG. 51 shows the level of IFN-γ in the peripheral blood measured in D2 orbital blood, and the tumor size and mass for each group. (Compared with NT group, *P<0.05, P<0.01, *P<0.0001). In vivo experiments showed GUCY2C CAR T cells can kill solid tumors in vivo and release INF-γ.

Figure 52:
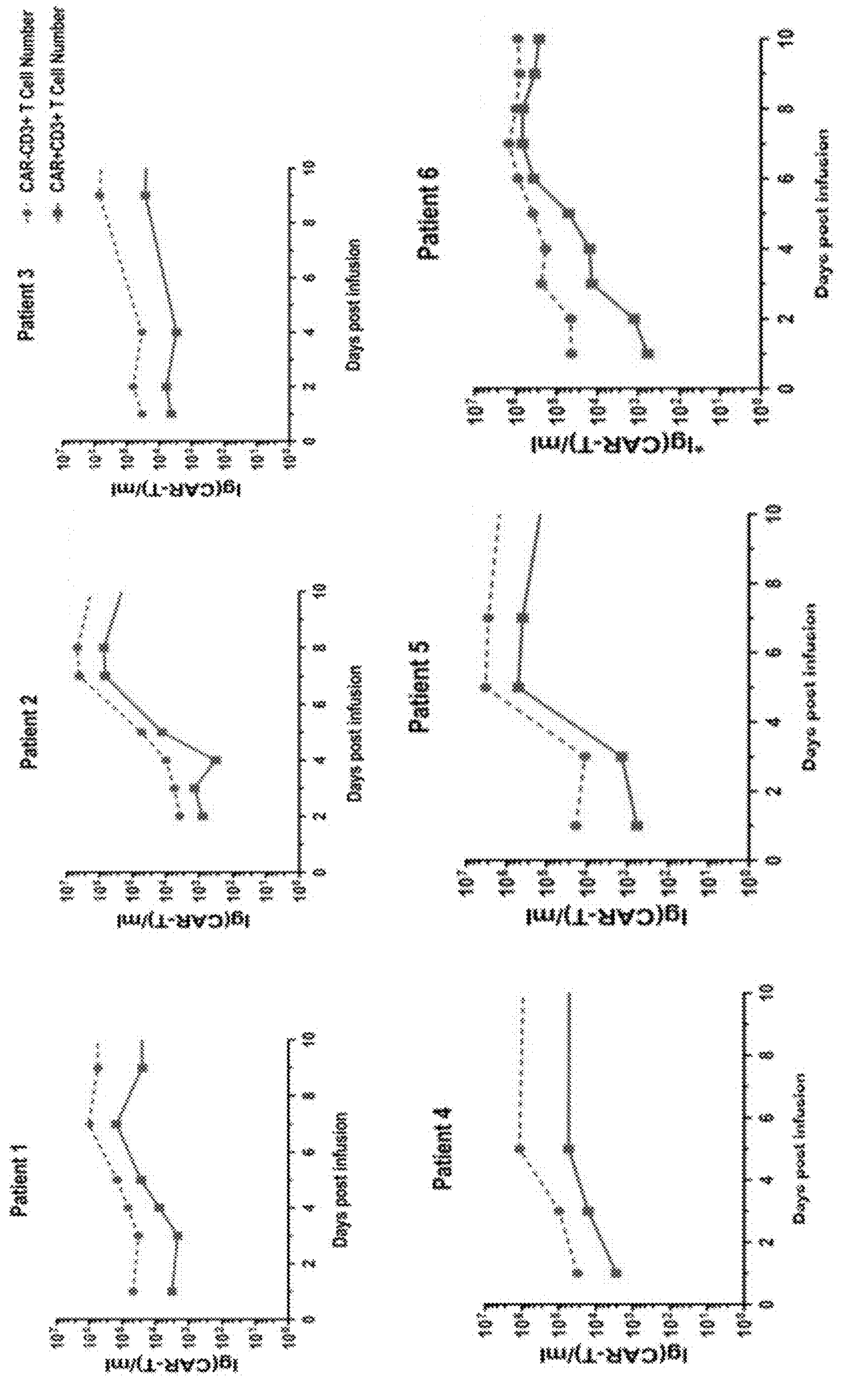
FIGS. 52 and 53 show CD19 CART cell activity induces proliferation in T cells by killing B cells in vivo and in vitro.
Figure 53:
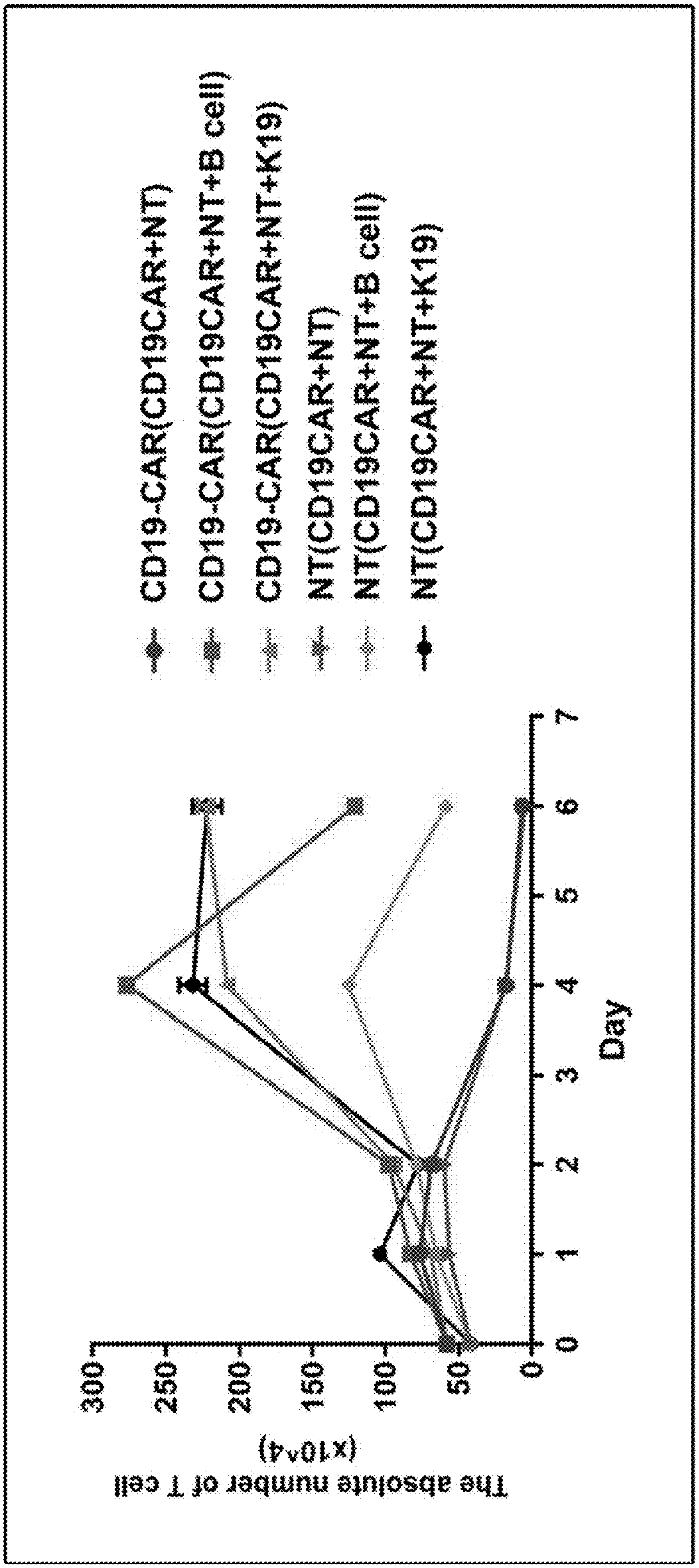

FIGS. 52 and 53 shows CD19 CART cell activity induces proliferation in NT cells by killing B cells. As shown in FIG. 52, according to the data of clinical trials in multiple clinical centers, Applicant analyzed the cell expansion of multiple patients after CD19 CAR T cell transfusion. FIG. 53 shows the coculture of CD19 CART cell and B cell day 1-day 6, the count of CAR T cell and NT cell. The cell groups were CD19 CAR+NT, CD19 CAR+NT+B cell, CD19 CAR+NT+k562-CD19; Chimeric antigen receptor T cell (CAR T) immunotherapy targeting the CD19 antigen. CD19 CART treatment for leukemia and lymphoma is effective in part because CD19 CAR infusion can quickly find the cancerous B cells and recognize antigen to kill the target cells. This results in a significant proliferation of the T cells. But in solid tumor patients, due to a lack of infiltration and tumor microenvironment inhibition, CAR T cells can't easily find the antigen to kill target cells and cause proliferation. Therefore, possible approaches that might result in proliferation of the solid tumor CAR were investigated. In previous multicenter clinical trial with CD19 CART for leukemia and lymphoma, it was unexpectedly found that not only did the CD19 CART cells proliferate, but the NT cells in the patients proliferated with the same trend. An in vitro model was established to demonstrate that CD19 CAR T cells can substantially promote proliferation of NT cells by killing normal B cells and/or CD19+ K562 cell line tumors.

Figure 54:
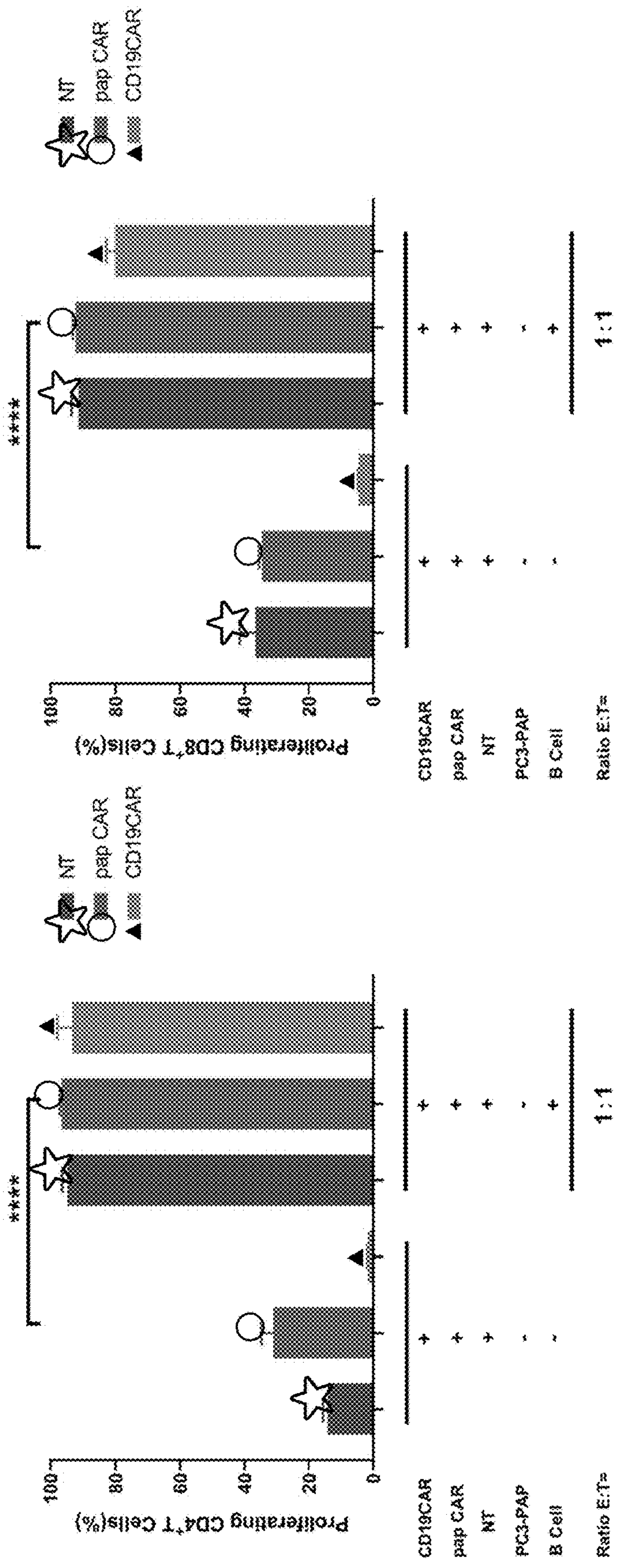
FIGS. 54 and 55 show antigen independent expansion of PAP CAR T cells and NT cells.
Figure 55:
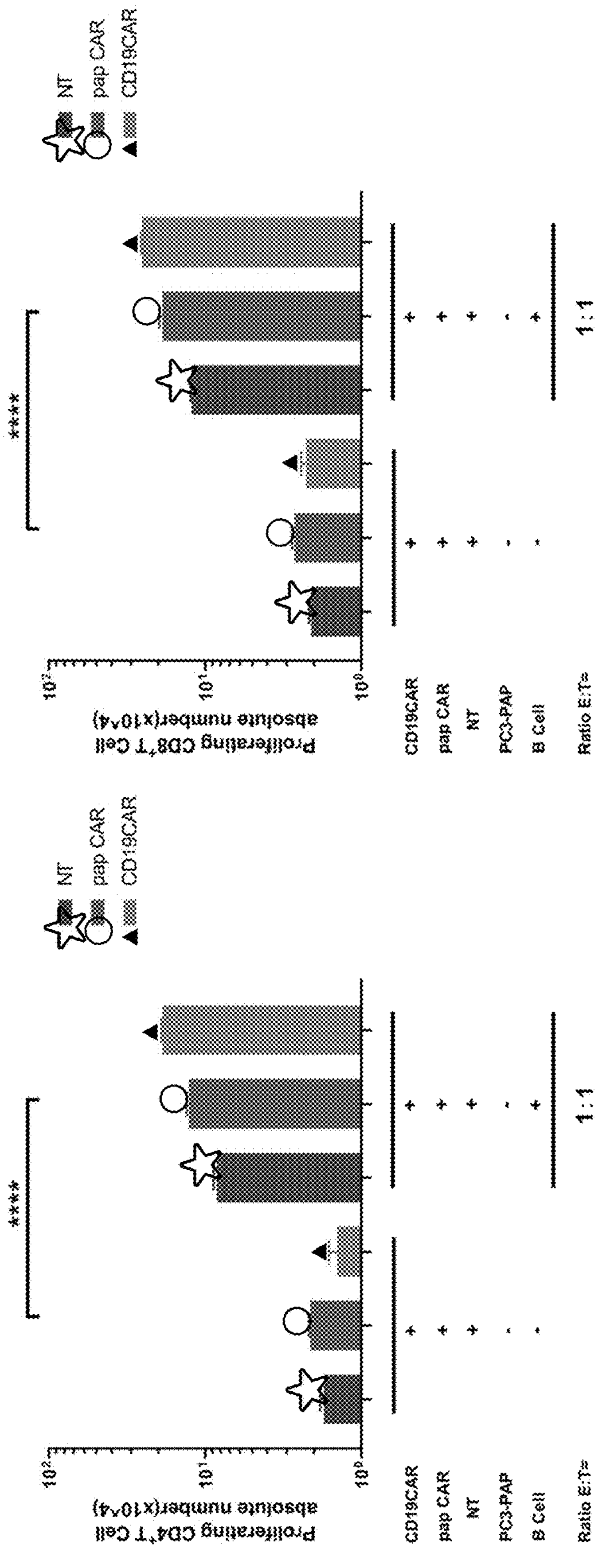

FIGS. 54 and 55 show antigen independent expansion of GUCY2C CAR T cells and NT cells. GUCY2C CAR+, CD4+/CD8+, GUCY2C CAR−, and CD4+/CD8+ cells were cultured for 96 h. The CoupledCAR® system included the GUCY2C CAR+ CD19 CAR+ group. CAR cells without target antigen cells in the coculture system served as the negative control. The experimental group was B cell with E:T=1:1 ratio. Flow fluorophore used APC labeled GUCY2C CAR cells. VIOLET fluorophore labeled CD19 CAR cells were cultured in different systems, and the proliferation of GUCY2C CAR and CD19 CAR cells were detected 96 hours later. The vertical coordinates of the plots show the percentage and absolute count of proliferation of CD4/CD8, GUCY2C CAR, NT, and CD19 CAR cells. Experimental results of in vitro proliferation showed that under the stimulation of B cells, the NT, CD19 CAR and GUCY2C CAR of CD4 and CD8 cells significantly proliferated (both in percentage of cells and absolute count of cells), and the proliferation effect on NT and CAR T cells was also higher as the proportion of B cells increased.

Figure 56:
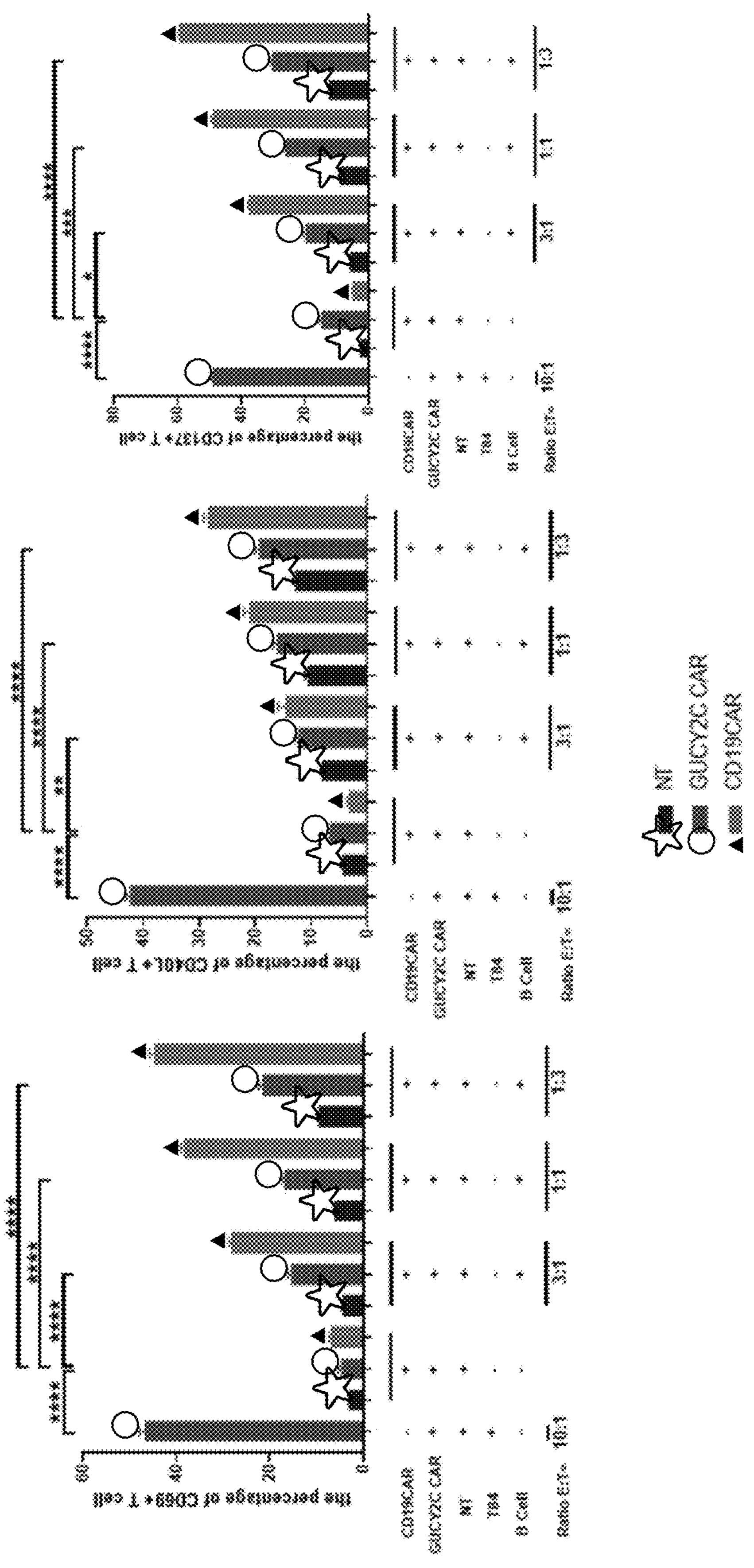
FIG. 56 shows that GUCY2C CAR T cells and NT cells was activated in CoupledCAR® system.

FIG. 56 shows that GUCY2C CAR T cells and NT cells was activated in a CoupledCAR® system. Activation of GUCY2C CAR T/NT/CD19 CAR T cells was shown in different groups during coculture (P value<0.05=*, <0.01=, <0.001=*, <0.0001=****; P≥0.05=no significance=NS). Flow detection results showed that in the CoupledCAR® system, both CD19 CAR and GUCY2C CAR could significantly up-regulate expression of CD69, CD137, and CD40L when interacting with APC cells such as B cells or GUCY2C positive T84 cells (respectively). The activation effect was increased in both CAR cells even without T84 cells as the proportion of B cells increased. This indicated that in the CoupledCAR® system, not only CD19 CAR can be activated, but also GUCY2C CAR and NT cells can be activated and the activation of GUCY2C CAR and NT cells is relatively weak compared with that of CD19 CAR T cells in the absence of T84 cells.

Figure 57:
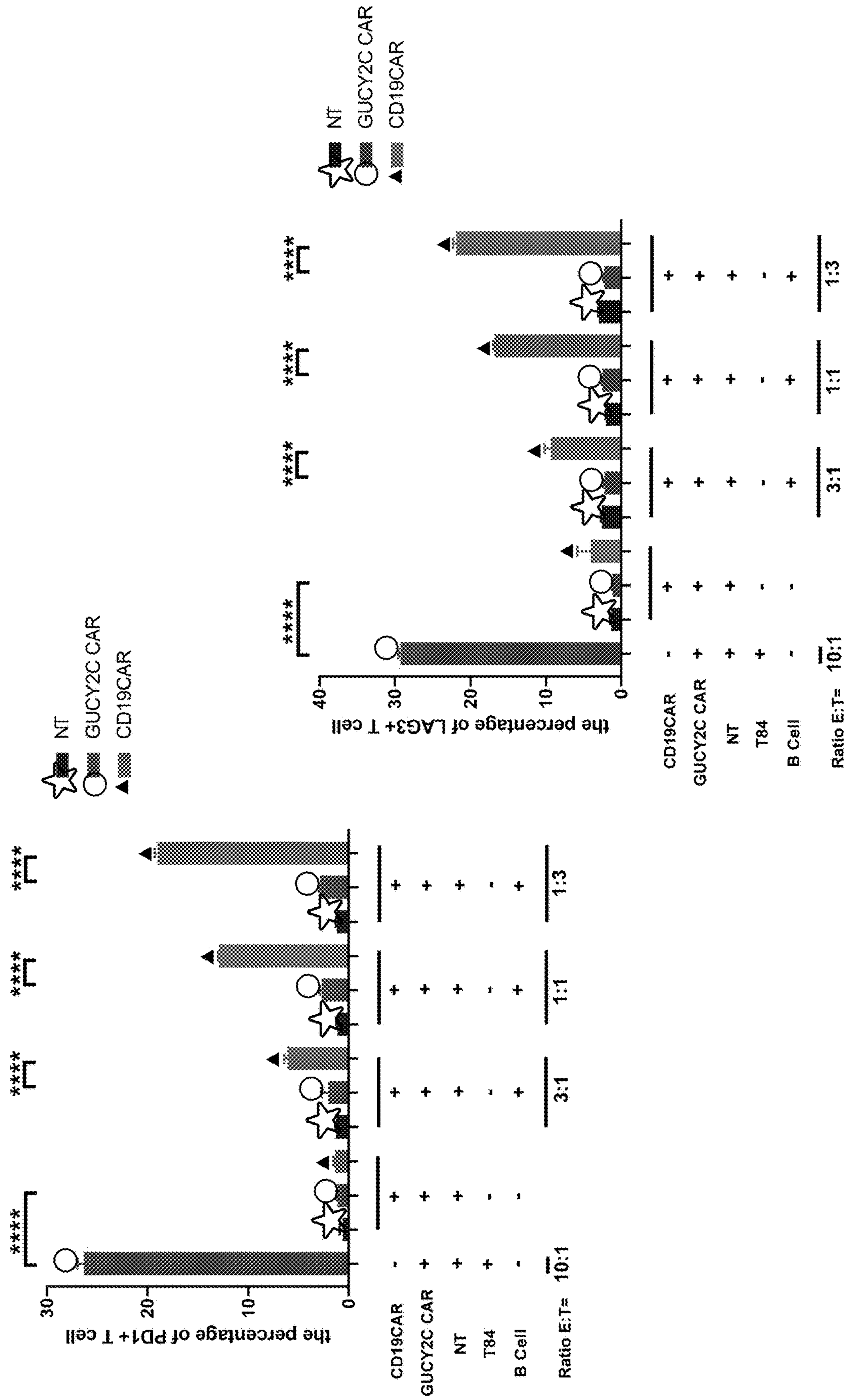
FIG. 57 shows that activation of CoupledCAR® system did not exhaust GUCY2C CAR.

FIG. 57 shows that activation of CoupledCAR® system did not exhaustGUCY2C CAR. Inhibition of different groups of GUCY2C CAR T/NT/CD19 CAR T cells in the process of coculture: proportion of PD1 and Lag3 (P value<0.05=*, <0.01=*, <0.001=*, <0.0001=**; P≥0.05=no significance=NS). Detection of T cell exhaustion markers showed that in the CoupledCAR® system CD19 CAR cells significantly up-regulated exhaustion markers PD1 and LAG3, but NT and GUCY2C CAR T did not show increased exhaustion marker expression. This indicates that compared with CD19 CAR, GUCY2C CAR not only significantly proliferates in the CoupledCAR® system, but the proliferation does not induce exhaustion in GUCY2C CAR cells, which makes the GUCY2C CAR better able to perform their killing function and maintain robust anti-tumor activity.

Figure 58:
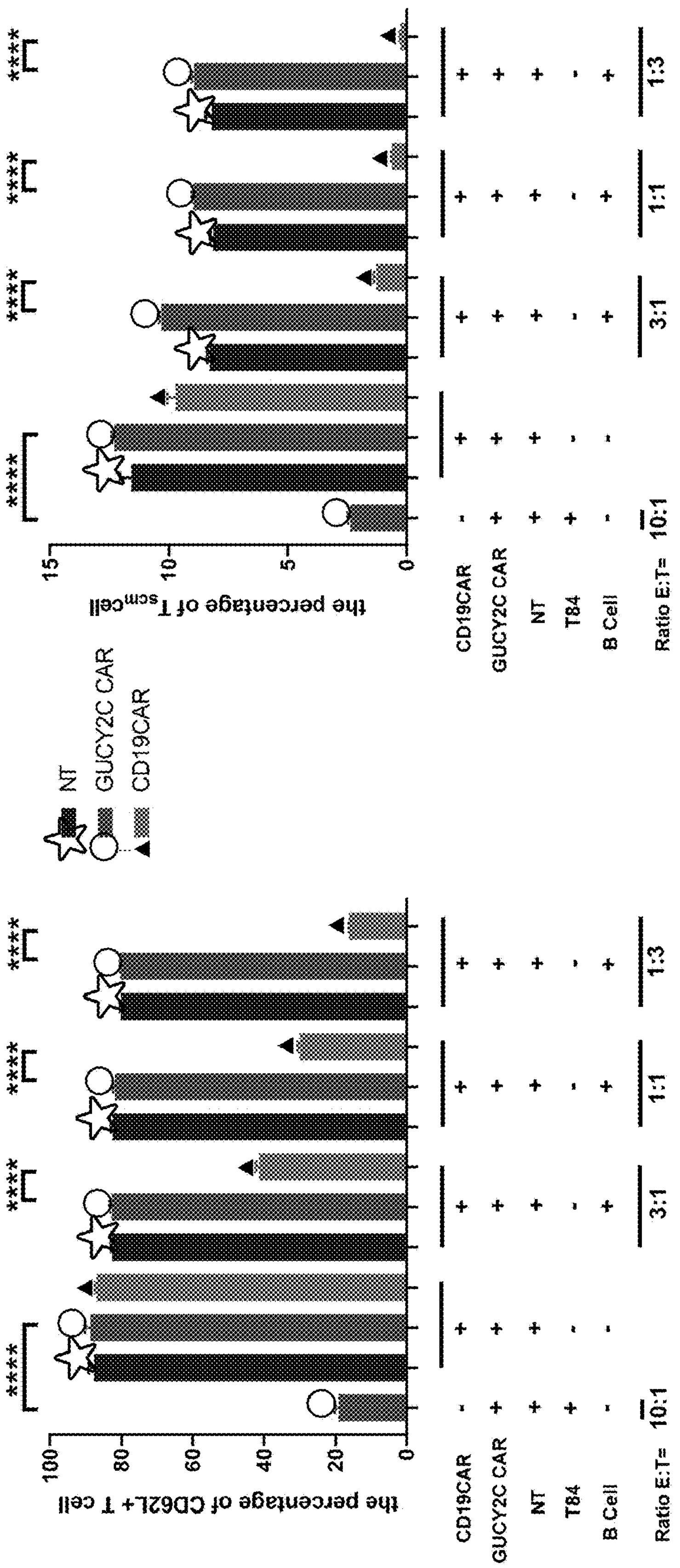
FIGS. 58 and 59 show that antigen independent expansion of GUCY2C CAR maintained one or more memory phenotypes.
Figure 59:
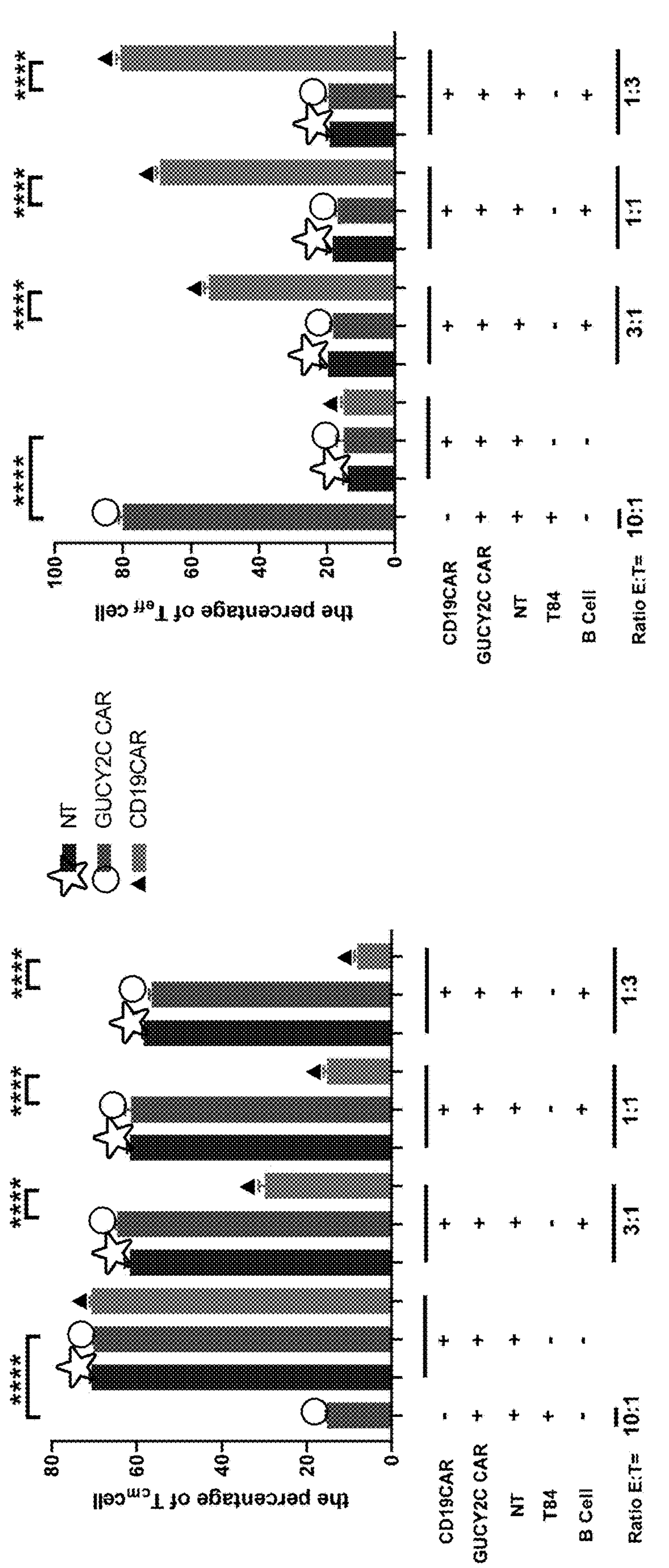

FIGS. 58 and 59 show that antigen independent expansion of GUCY2C CAR maintained memory status. The proportion of memory T cells, effector T cells, and stem like central memory T cells in different groups of GUCY2C CAR T/NT/CD19 CAR T cells during coculture is shown in FIGS. 58 and 59. The memory cells were identified by CD62L and CD45RA expression (P value<0.05=*, <0.01=, <0.001=*, <0.0001=****; P≥0.05=no significance=NS). Memory T cell detection results showed that in the CoupledCAR® system, CD19 CAR rapidly differentiated T cells in the process of killing B cells, and only a few memory cells existed, and there were more Teff cells with an increase in E:T ratio. However, GUCY2C CAR cells maintained a proportion of memory and stem like T cells in the CoupledCAR® system. The larger quantity of GUCY2C CAR memory T cells maintains high differentiation potential, which can better help CAR T cells persist and kill solid tumors. This in turn should result in longevity or continuance of the GUCY2C CART cell therapy.

CoupledCAR®: Single-cell RNA-Sequencing Analyses of Tumor Tissue from a Colorectal Cancer Patient with Thyroid Cancer after CAR T Cells Infusion Chimeric antigen receptor (CAR) T cell therapy in solid tumors is limited by various intrinsic and extrinsic factors, including poor expansion and low degree of infiltration to the tumor site. We have recently addressed the limitation of CAR T cell expansion against difficult-to-treat solid tumors, but It remains to be established whether our CAR T products have been equipped with the capacity of tumor infiltration. To confirm CART cell infiltration into solid tumor, deep single-cell RNA sequencing on T cells isolated from tumor tissue (lung metastasis) and on adjacent peripheral blood (PB) from Patient 009 with thyroid cancer was performed. This study was also designed to depict the baseline landscape of infiltrating CAR T cells, especially the TSHR CAR T cells in thyroid cancer.

The T cells in this study included CAR-negative T cells (normal T cells) and CAR-positive T cells which consisted of CD19 CART cells (CD19 CAR), TSHR CART cells (TSHR CAR), and T cells incorporated with both of the two CAR constructs (a CoupledCAR® system). These CAR-positive T cells in tumor tissue were predominantly TSHR CAR T cells and have shown a significant proportion of proliferative and cytotoxic T cells, which was evidenced by the signature gene expression.

Subsequently, a high capacity of TSHR CAR T cell infiltration was observed. These cells also showed a high degree of cytotoxicity and trafficking activity, characterized by the high expression of known functional markers. Additionally, a great diversity of TSHR CAR T cell clones in tumor tissue was observed, which was different from TSHR CAR T cell clones in PB. The inferred developmental trajectory of CAR-positive CD8 T cell in PB and tumor tissue indicates that CAR T cell products described herein can undergo extensive transitions.

Figure 60A:
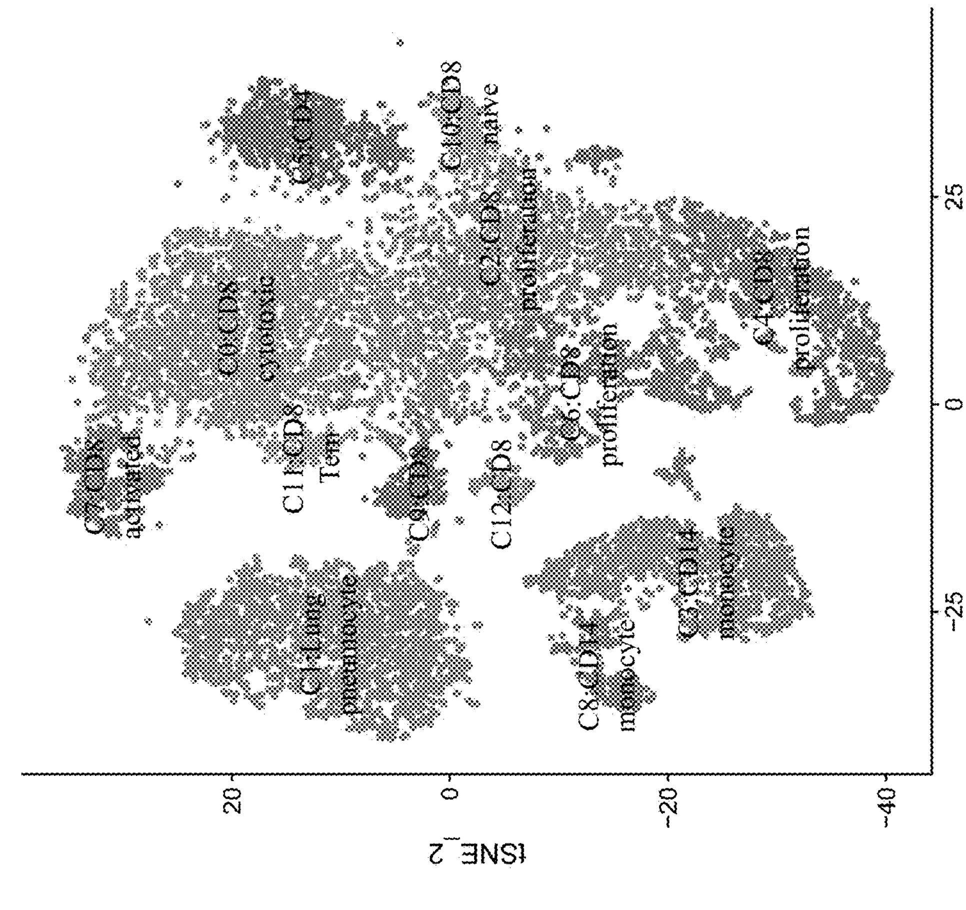
FIGS. 60A and 60B show that T cells derived from both peripheral blood (PB) and tumor tissue of a colorectal cancer patient with thyroid cancer are capable of robust proliferation and cytotoxicity.
Figure 60B:
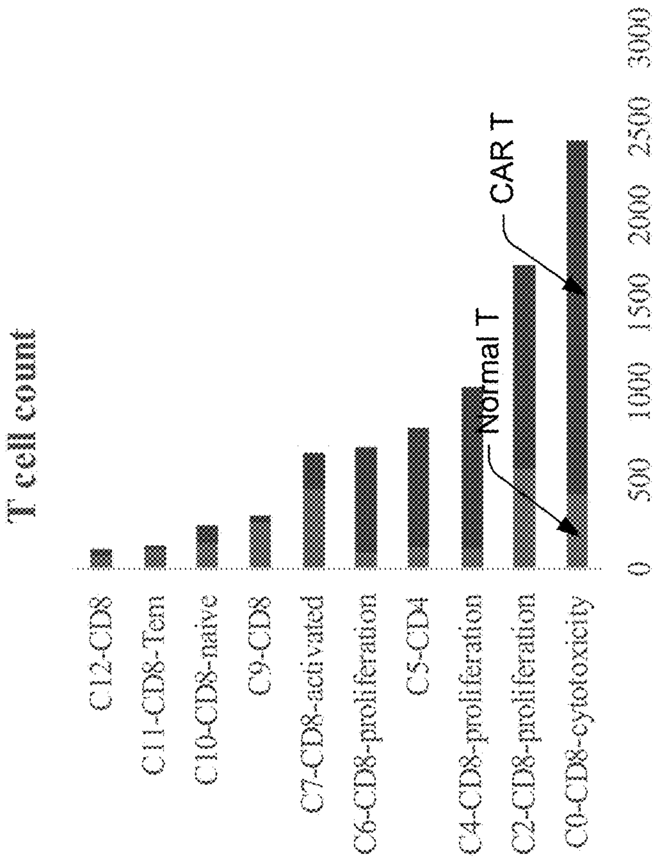

FIGS. 60A and 60B show that T cells derived from both PB and tumor tissue of a colorectal cancer patient with thyroid cancer are capable of robust proliferation and cytotoxicity. These data are restricted to T cells including TSHR CAR, CD19 CAR, the CoupledCAR® system and normal T cells. The integrated expression datasets derived from both peripheral blood (PB) and tumor tissue (lung metastasis) of Patient 009 were applied to dimensional reduction analysis (t-SNE). We identified ten T cell clusters, including clusters of CD8 (proliferation, cytotoxicity, naïve, and effector memory). FIG. 60B. These clusters appeared to be almost exclusively proliferative and cytotoxic T cells. There were 3447 proliferative T cells, and 77.7% of which were CAR-positive T Cells. There were 2431 cytotoxic T cells and 82.8% were CAR-positive. These results show most of these CAR-positive T cells are cytotoxic and proliferative T cells, providing compelling evidence of proliferative and antitumor capacity of the CAR T products described herein.

Figure 61:
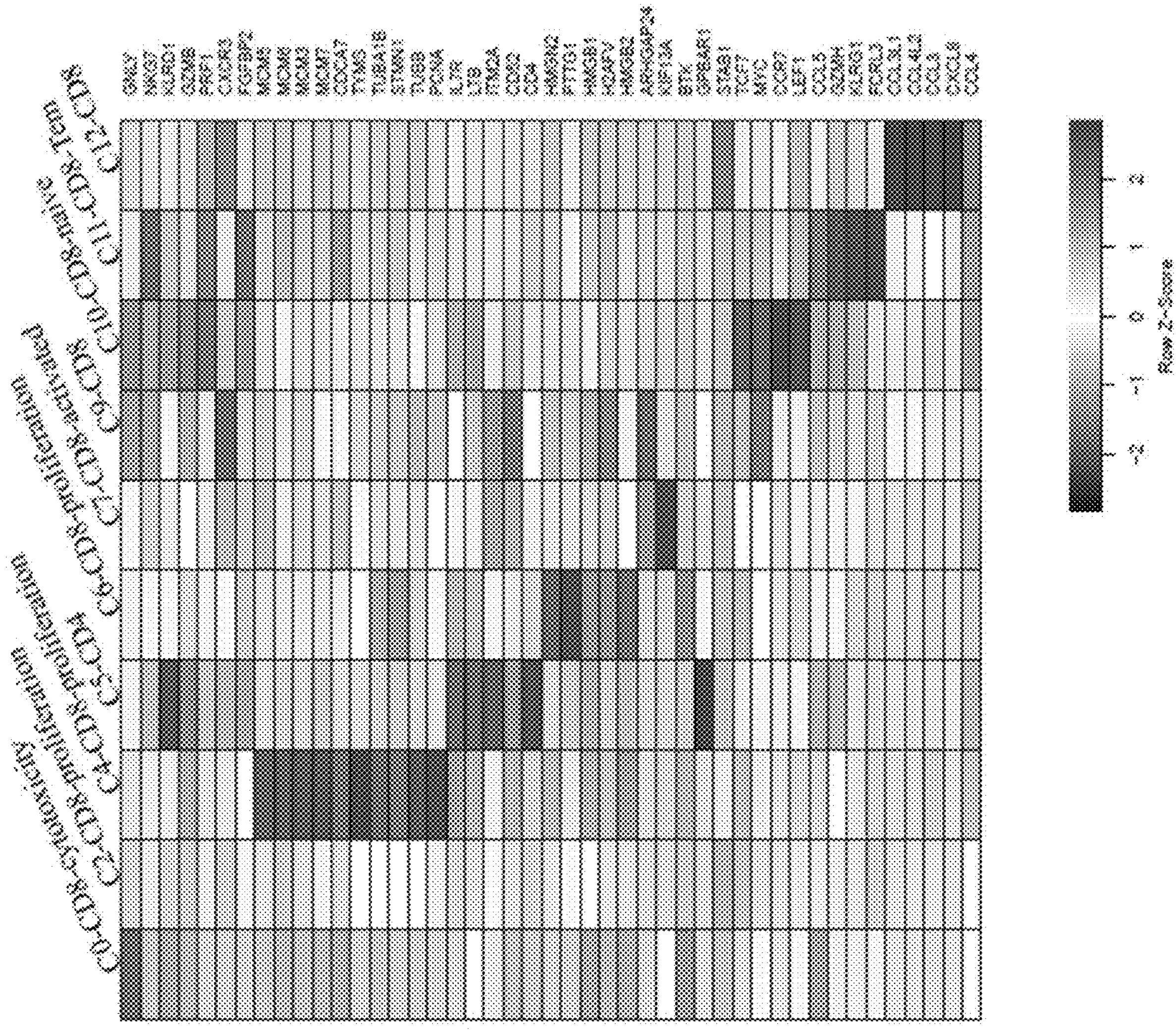
FIG. 61 shows that identification of all T cell clusters in PB and tumor tissue were evidenced by expression of signature genes and known functional markers.

FIG. 61 shows that identification of all T cell clusters in PB and tumor tissue was evidenced by expression of signature genes and known functional markers. These data are restricted to T cells including TSHR CAR, CD19 CAR, the CoupledCAR® system and normal T cells. Dynamic changes in gene expression between T cell clusters in peripheral blood (PB) and tumor tissue (lung metastasis) have been identified and were used for cluster analysis. It was observed that cytotoxic T cells in the CO cluster were characterized by high expression of genes associated with cytotoxicity, including GNLY, GZMB, PRF1, CXCR3 and FGFBP2. Genes involved in the "cell cycle" and "proliferation" pathways, such as TYM, STMN1, MCM, HMGB1/2, and HMGN2, were highly expressed in corresponding clusters CD8-proliferation (C2, C4, C6). A well-defined subset of naïve T cells (C10) showed high expression of naïve markers (TCF7, CCR7, LEF1). Accordingly, high expression of chemokines in C12 cluster supported the potential migratory feature of these T cells.

Figure 62A:
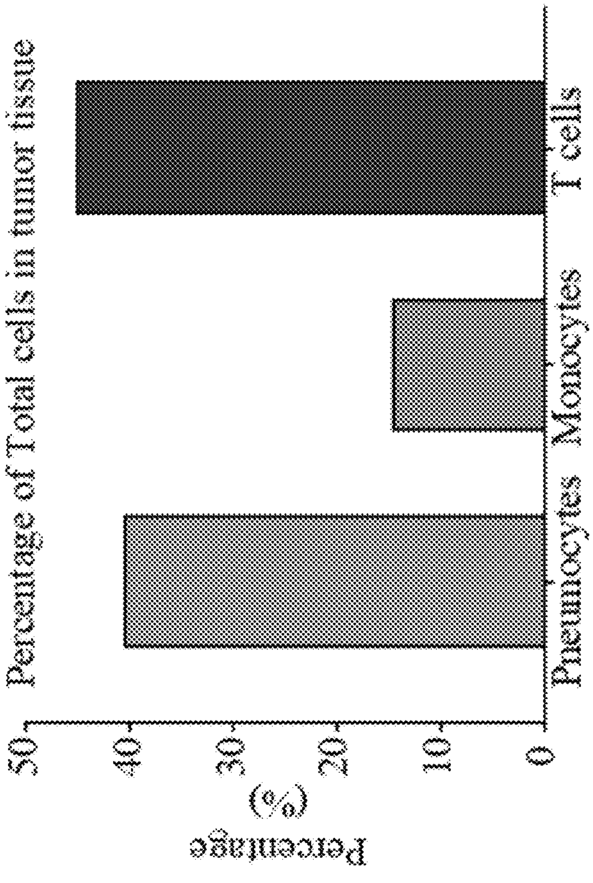
FIGS. 62A-62C show that TSHR CAR T cells are significantly enriched in tumor tissue confirming the capacity of CAR T cell infiltration into tumor. These data are restricted to just TSHR CAR T cells.
Figure 62B:
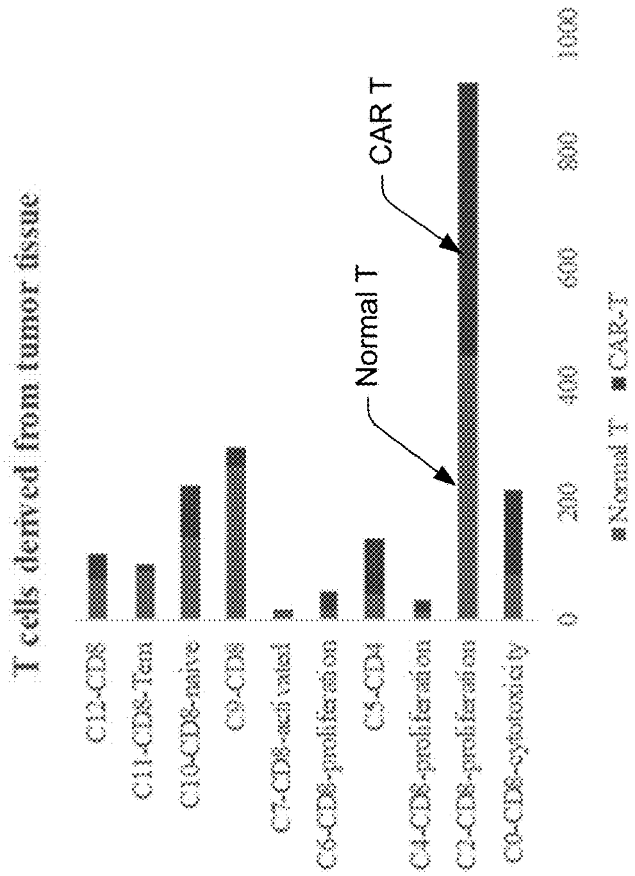
Figure 62C:
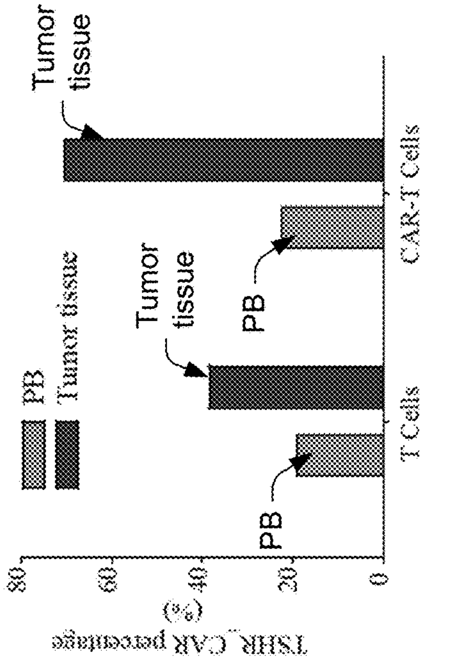

FIGS. 62A-62C shows that TSHR CAR T cells are significantly enriched in tumor tissue confirming the capacity of CAR T cell infiltration into tumor. These data are restricted to just TSHR CAR T cells. FIG. 62A. A total of 4670 single cells including three subtypes were isolated in the tumor tissue of Patient 009, among which pneumocytes accounted for 40.5%, monocytes for 14.5%, and T cells for 45.0%. FIG. 62B. CAR-positive T cells derived from tumor tissue appeared to be almost exclusively proliferative and cytotoxic T cells. C. The statistics of the TSHR CAR T cells in tumor tissue were compared with peripheral blood (PB) from Patient 009. TSHR CAR T cells in PB composed 19.20% of T cells and 22.36% of CAR-positive T cells. Significant increases in levels of TSHR CAR T cells (38.38% of T cells and 70.60% of CAR-positive T cells) in tumor tissue, with an increase by a factor of 2-3 as compared with PB was observed. CD19 CART cells were not enriched in tumor tissue (data not shown). These results show TSHR CAR T cells are significantly enriched in tumor tissue which confirms the capacity of CAR T cell infiltration into tumor, and it is not surprising that tumor cells in the tumor tissue were not detected by deep single-cell RNA sequencing, given that the antitumor response against solid tumor associated with cytotoxicity of the CART cells described herein.

FIGS. 63A-63D show rare clonotype was found to be shared by TSHR CAR T cells in PB and tumor tissue. These data are restricted to just TSHR CAR T cells. FIG. 63A. 1056 and 502 TSHR CAR T cell clones in PB and tumor tissue, respectively, were identified. Only two clones with identical TCRs were detected. FIG. 63B. Only three clonotypes were present in at least two TSHR CAR T cells from PB. FIG. 63C. No clonotype was enriched in the TSHR CAR T cells from tumor tissue. FIG. 63D. One clonotype was found to be shared by TSHR CAR T cells in PB and tumor tissue. These results show one clonotype was found to be shared by TSHR CAR T cells in PB and tumor tissue, indicating a great diversity of TSHR CAR T cell clones between PB and tumor tissue.

Figure 64A:
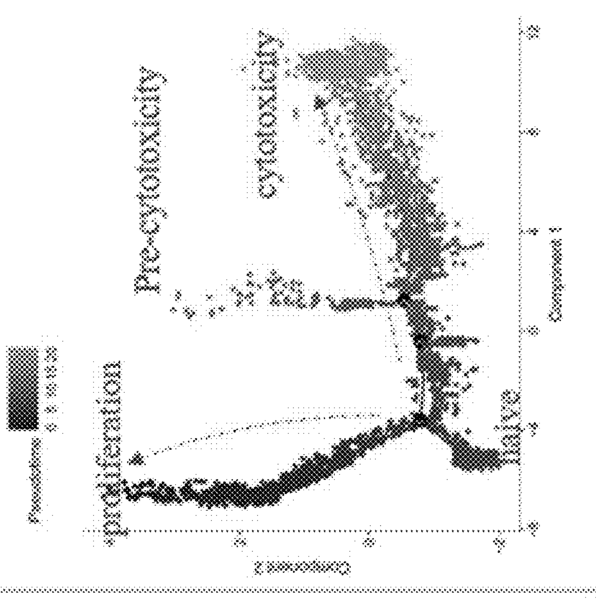
FIGS. 64A-64D show an inferred developmental trajectory of CAR+ CD8 T cells in PB suggesting a branched structure with differentiated proliferation and cytotoxicity T cells.
Figure 64B:
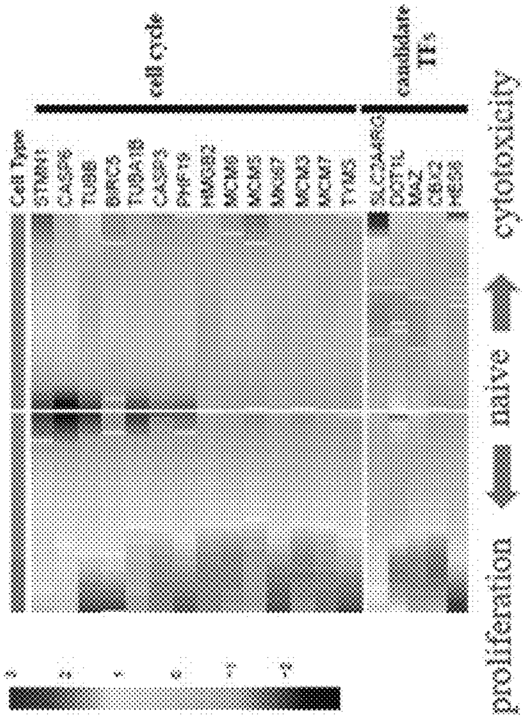
Figure 64C:
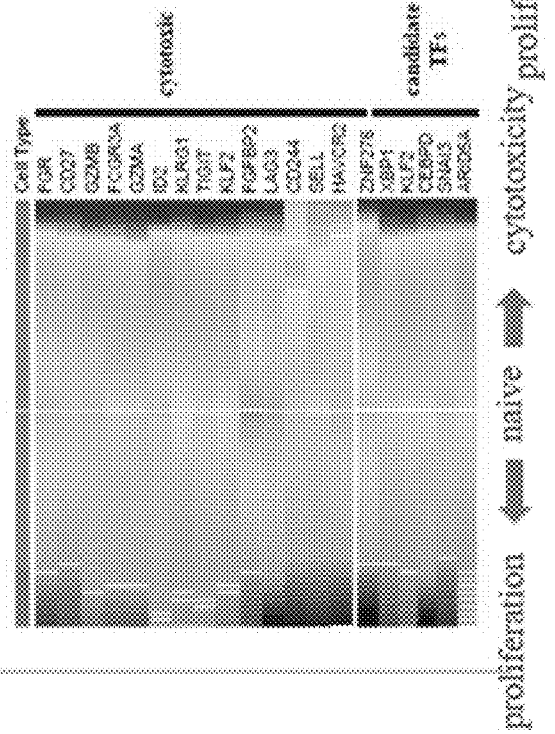
Figure 64D:
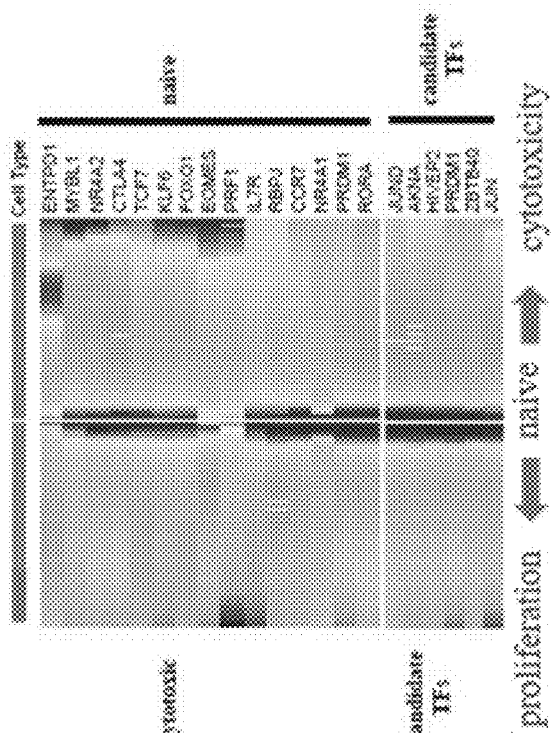

FIGS. 64A-64D show an inferred developmental trajectory of CAR-positive CD8 T cell in PB suggested a branched structure with differentiated proliferation and cytotoxicity T cells. These data are restricted to all CAR-positive CD8 T cells. FIG. 64A. The branched trajectory of CAR-positive CD8 T cell state in PB transited in a two-dimensional state-space with arrows showing the increasing directions of certain T cell properties. According to original state labeled as the naïve T cells, differentiated T cells could be classified as proliferation and cytotoxicity, which undergo two distinct state transitions. FIGS. 64B, 64C, and 64D. Highly expressed signature genes exhibited distinct expression patterns among our corresponding three CD8 clusters: proliferative T cells with high expression of proliferation-related genes, naïve T cells with high expression of naive-related genes, cytotoxic T cells with high expression of cytotoxicity-related genes. These results show CAR-positive CD8 T cell in PB will be differentiated into two different fates: proliferation and cytotoxicity. Cell fate decisions are regulated by high expression of signature genes.

FIGS. 65A-65D show another inferred developmental trajectory of CAR-positive CD8 T cell in tumor tissue suggesting a branched structure with differentiated proliferation and cytotoxicity T cells. These data are restricted to CAR-positive CD8 T cells. FIG. 65A. The branched trajectory of CAR-positive CD8 T cell state in tumor tissue transited in a two-dimensional state-space with arrows showing the increasing directions of certain T cell properties. According to original state labeled as the naïve T cells, differentiated T cells could be classified as proliferation and cytotoxicity, which undergo two distinct state transitions. FIGS. 65B, 65C, and 65D. Highly expressed signature genes exhibited distinct expression patterns among our corresponding three CD8 clusters: proliferative T cells with high expression of proliferation-related genes, naïve T cells with high expression of naive-related genes, cytotoxic T cells with high expression of cytotoxicity-related genes. As well as T cells in PB, two subtypes of differentiated CAR-positive CD8 T cells with properties of proliferation and cytotoxicity were present in tumor tissue. The proliferative T cells appeared to exhibit high degrees of expansion in vivo, and cytotoxic T cells displayed profound antitumor activity.

Figure 66:
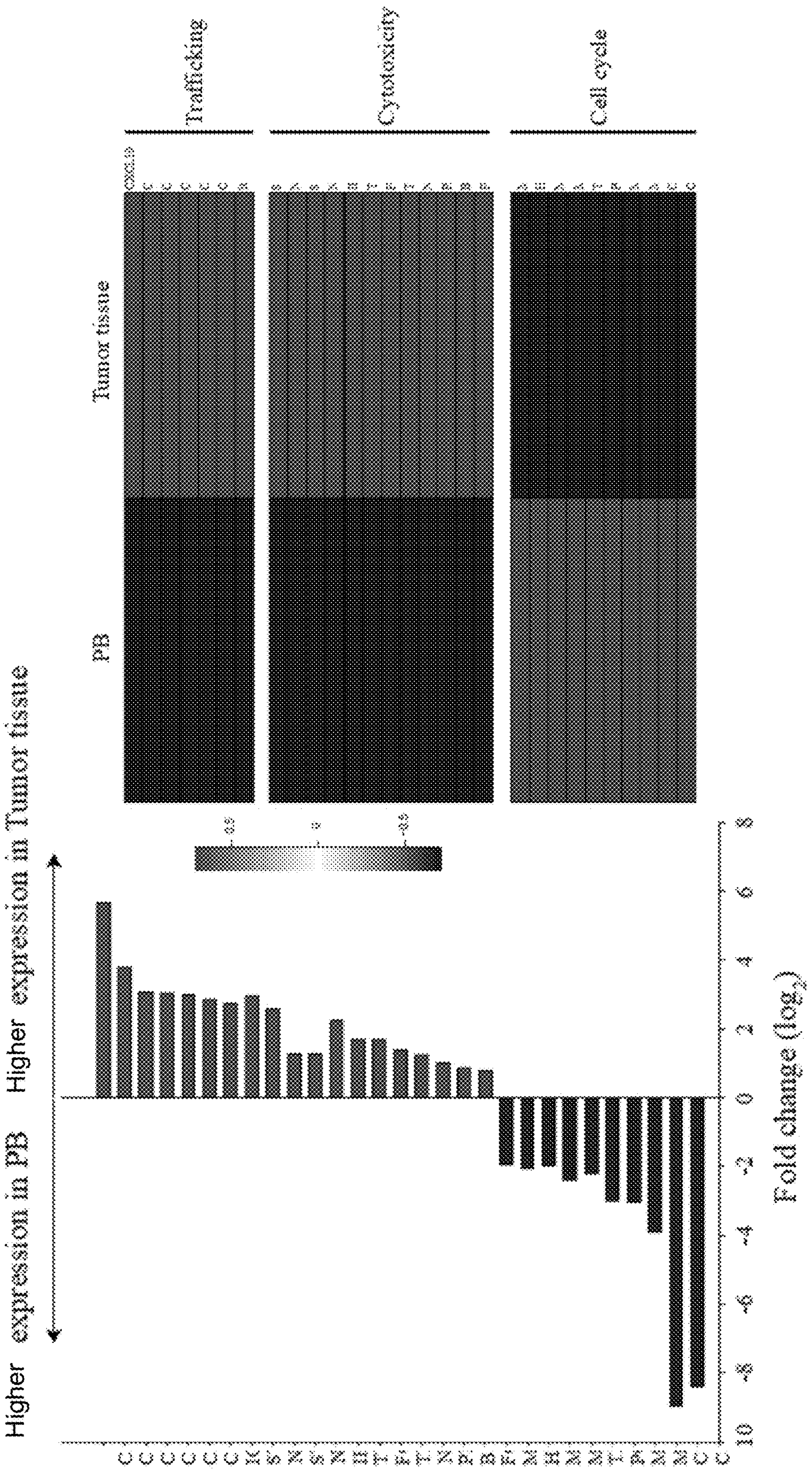
FIG. 66 shows TSHR CAR T cells in tumor tissue exhibited higher degree of trafficking and cytotoxicity, as compared with TSHR CAR T cells from PB.

FIG. 66 shows TSHR CAR T cells in tumor tissue exhibited higher degree of trafficking and cytotoxicity, as compared with TSHR CAR T cells from PB. These data are restricted to just TSHR CAR T cells. Differential expression analyses of RNA-sequencing data of TSHR CAR T cells from PB and tumor tissue were performed and showed higher expression of trafficking-related and cytotoxicity-related genes in tumor tissue as compared to TSHR CAR T cells in PB. Cell cycle-related genes were are expressed at a higher level in PB. TSHR CAR T cells in tumor tissue exhibited higher degree of trafficking and cytotoxicity, as compared with TSHR CAR T cells from PB.

Deep single-cell RNA sequencing was applied to a lung sample of a patient with thyroid cancer and characterized the T cell landscaping, especially the TSHR CAR T cells, which showed a significant proportion of proliferative and cytotoxic T cells in tumor tissue. Multiple comparisons for TSHR CAR T cells between PB and tumor tissue were performed and indicated a higher capacity of CAR T cell infiltration, trafficking, and cytotoxicity in tumor tissue. These findings provide a plausible explanation for the positive responses of TSHR CAR T cells to immunotherapies for thyroid cancer. Additionally, CAR T cell products described herein might undergo extensive state transitions, which appeared to be shaped by two distinct processes, the CAR T cells proliferation and tumor-induced CAR T cells cytotoxicity. Overall, this large compendium of single-cell data can elucidate the tumor-immune interactions by providing insights into the composition, states, and dynamics of CoupledCAR® T cell products in thyroid cancer. This approach for high-dimension and high-resolution characterization of single immune cells are applicable to other types of cancer and the use of other products for treating different types of cancer.

CoupledCAR®: GUCY2C-Redirected Chimeric Antigen Receptor T-Cell Therapy Induce Complete Remission with Enhanced Expansion by Antigen-Independent Stimulation in Advanced Colorectal Cancer Chimeric antigen receptor (CAR)-redirected T cell therapy has been successful in the treatment of hematologic malignancies. However, CAR therapy against solid tumors has provided modest benefits. One significant reason for this is the difficulty in CAR T cells contacting tumor antigen because of intratumoral steric hindrance, which has restricted antigen-dependent expansion of adoptive T cells in vivo.

Preclinical data demonstrated that CD19-specific CART celltherapy for acute lymphoblastic leukaemia could induce remarkable expansion of normal T cells in the peripheral blood, which was consistent with a robust in vivo CD19 CAR T cell expansion. Building on this observation, CD19 CAR construct was incorporated into the GUCY2C-targeted CART cells to address the need for rapid and extensive expansion of CAR T cells and antitumor potency against advanced colorectal cancer. CD19 CAR vectors was designed and additionally engineered with a CAR-inducible cytokine cassette with the property of secreting IL-12 for T cell expansion, IL-6, and IFN-γ for CAR T cell infiltration into tumor sites, upon CAR binding a tumor antigen.

Colorectal cancer, one of the most common malignancies among both men and women worldwide, is responsible for more than 8% of new cancer diagnoses and ranks second for global cancer-related deaths. GUCY2C (guanylate cyclase 2C) is an attractive tumor specific self-antigen because it is expressed in more than 90% of colorectal cancer across all stages and has restricted expression in normal tissues. To evaluate the safety and therapeutic potential of GUCY2C CoupledCAR® T cell therapy for the treatment of advanced colorectal cancer, a clinical trial was initiated and reported below.

Partial and complete remission of all metastatic tumor lesions was subsequently observed at 1.5 and 3 months after treatment, respectively. The CAR T cells expanded to a level that was more than 500 times as high as the initial engraftment level, along with corresponding increases in levels of cytokines in the peripheral blood after the initiation of CAR T cell therapy. GUCY2C CAR positive chimeric antigen receptor T cells persisted for at least 3 months. The grade 1 cytokine-release syndrome and grade 2/3 neurological toxicity have resolved, which did not prevent expansion of chimeric antigen receptor T cells or reduce antitumor efficacy.

This complete response indicates an increased feasibility of antigen-independent CAR T cell expansion against a difficult to treat solid tumor and opened opportunities for extending this approach to patients with other cancer types.

Figure 67A:
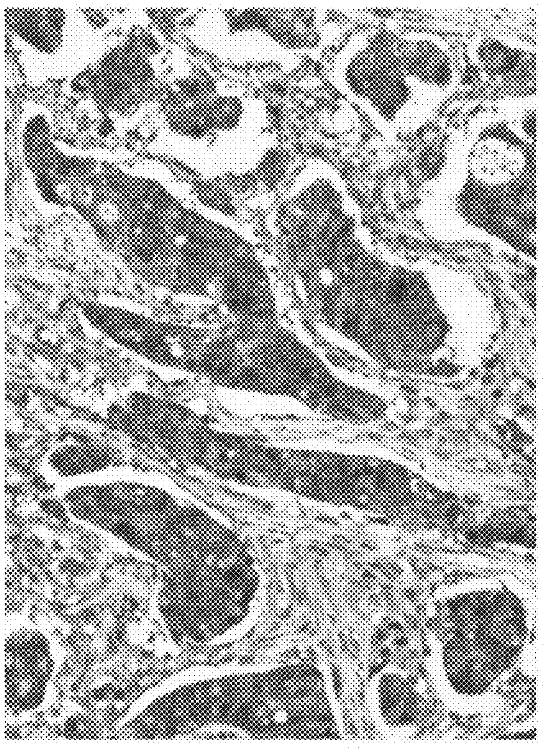
FIGS. 67A-67C show GUCY2C CoupledCAR® T cells (e.g., GUCY2C CAR T cells and CD19 CART cells) were successfully generated.
Figure 67B:
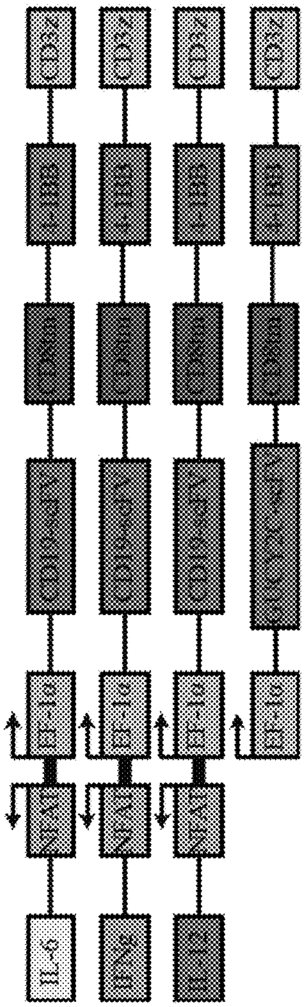
Figure 67C:
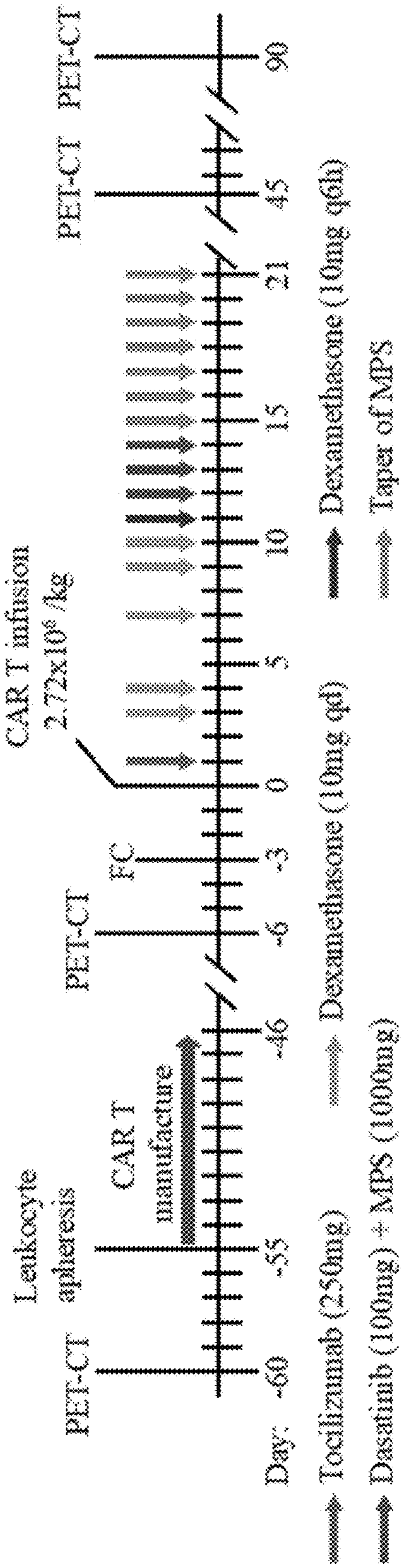

FIGS. 67A-67C shows GUCY2C-CoupledCAR® T cells were successfully generated. FIG. 67A. Immunohistochemistry showed that GUCY2C was expressed in >90% of the tumor cells with high-intensity staining. FIG. 67B. GUCY2C-CoupledCAR® T cells were successfully generated through lentiviral transduction using GUCY2C-specific and CD19-specific CAR into autologous T cells from the patient. The CD19 CAR was also empowered to secrete IL-6, IL-12, and IFNγ, simultaneously. FIG. 67C. An overview of the CART cell infusion is shown. These results shown in FIGS. 67A-67C demonstrate GUCY2C (guanylate cyclase 2C) is an attractive tumor specific self-antigen. GUCY2C-CoupledCAR® T cells were successfully generated.

Figure 68:
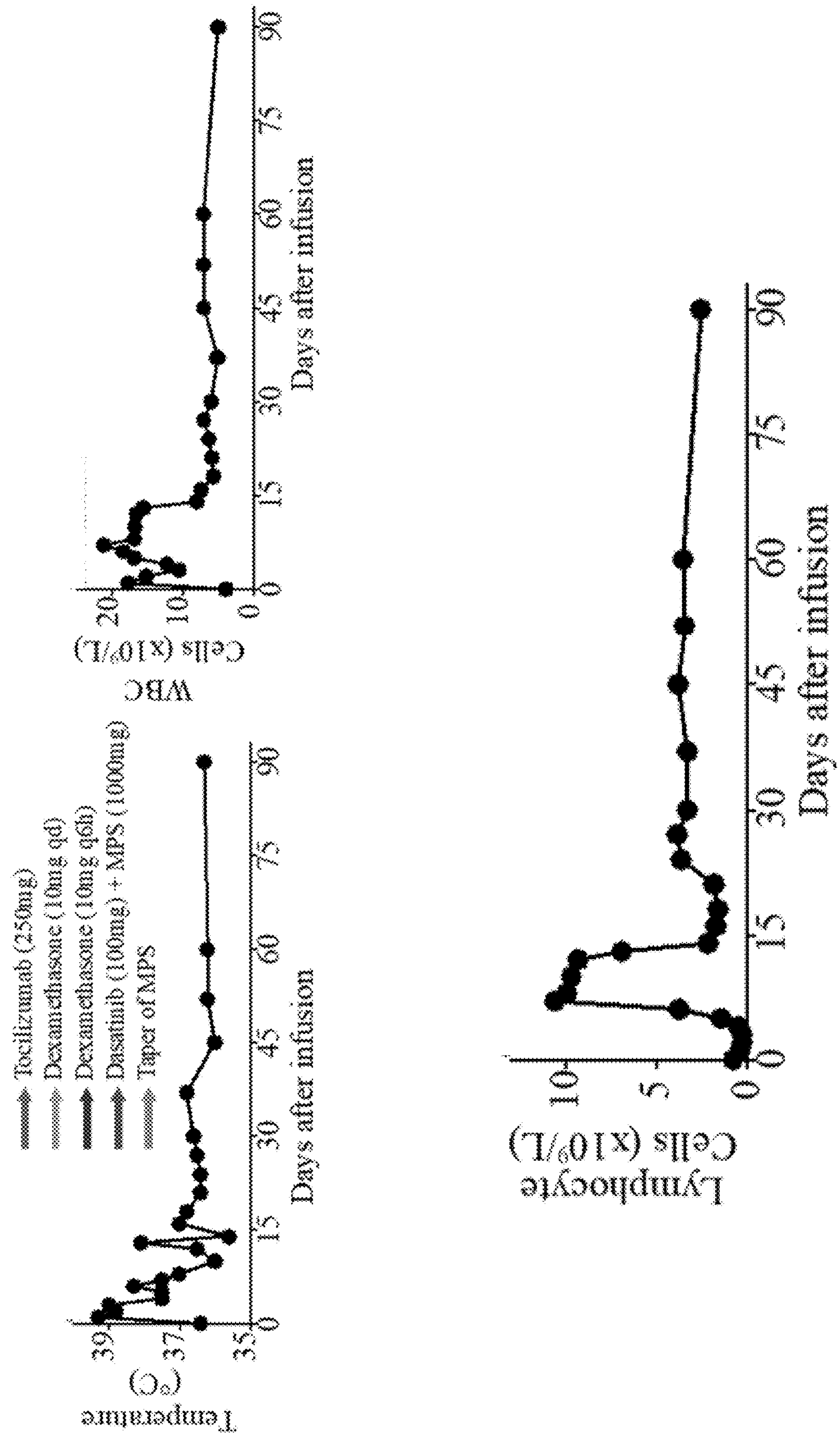
FIG. 68 shows increased blood cells and body temperature after CAR T cell infusion.

FIG. 68 shows increased blood test levels and body temperature were observed after CAR T cell infusion. The body temperature had escalated to 39.3° C. on day 1 after CAR T cell infusion and was within the normal range after 7 days. The total white blood cell count had risen to $17.69\times10^9$/L on day 1. The absolute lymphocyte count peaked at $10.62\times10^9$/L on day 7 (with T cells accounting for 92.4%), as compared with $0.78\times10^9$/L (with T cells accounting for 57.3%) on day 0 before CAR T cells infusion. These results show increased white blood cell count and body temperature after CAR T cell infusion.

Figure 69:
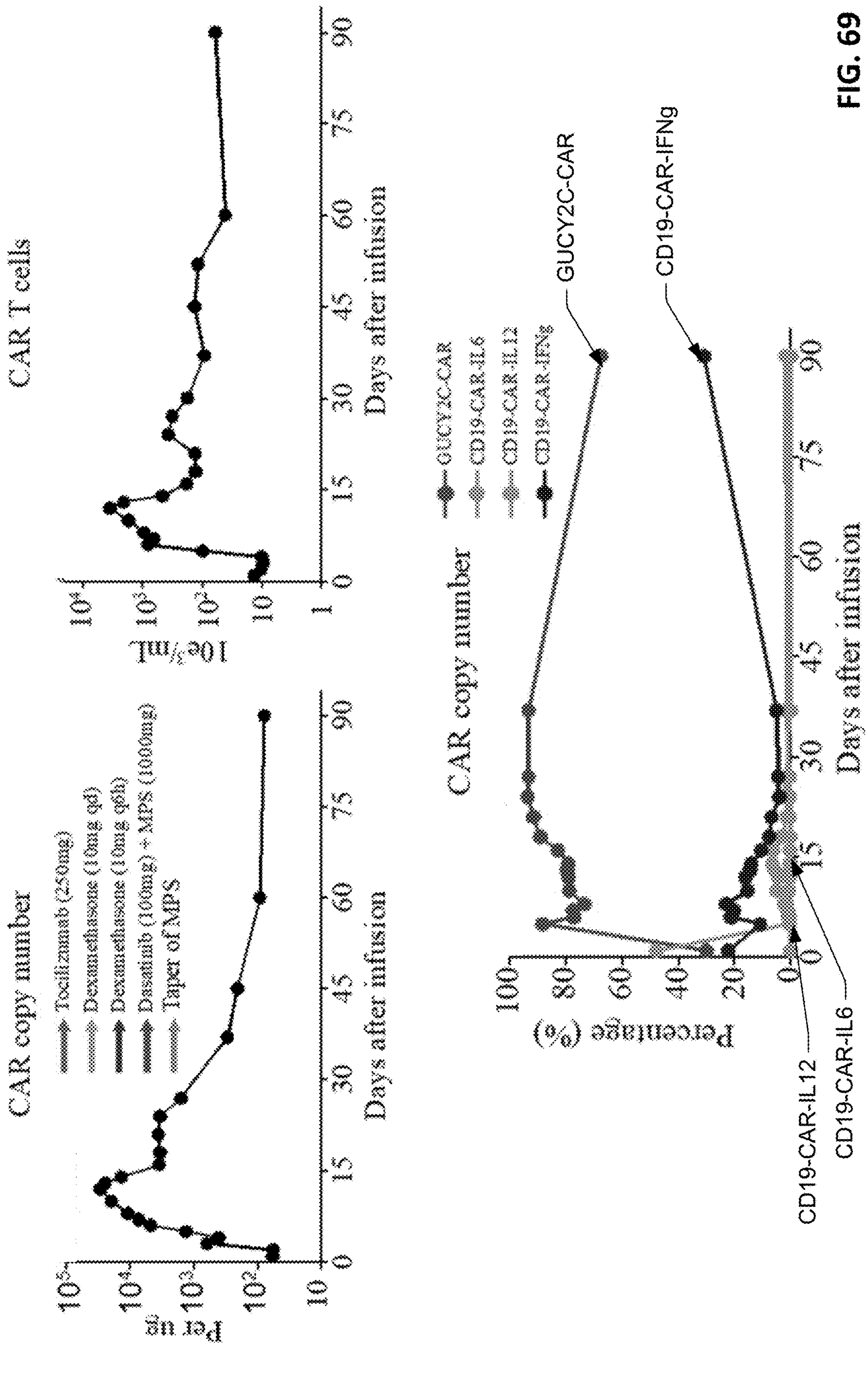
FIG. 69 shows CAR T cells expanded to a level that was more than 500 times as high as the initial engraftment level.

FIG. 69 shows CAR T cells expanded to a level that was more than 500 times as high as the initial engraftment level. The total CAR copy number elevated to a peak of 29372 copies/ug on day 12, which was more than 500 times as high as the initial level on day 1. GUCY2C-CoupledCAR® T cells expanded to $3.5\times10^6$/mL by day 12 after infusion. The frequency of DNA encoding GUCY2C CAR rose to more than 85% of the total CAR DNA on day 5 and peaked on day 23 (93.6% of total CAR DNA) after CAR T cells infusion, which was close to the level of final infused product (GUCY2C CAR DNA composed 98.3% of total CAR DNA copies). These results show robust CAR T cell expansion in vivo against colorectal cancer.

Figure 70:
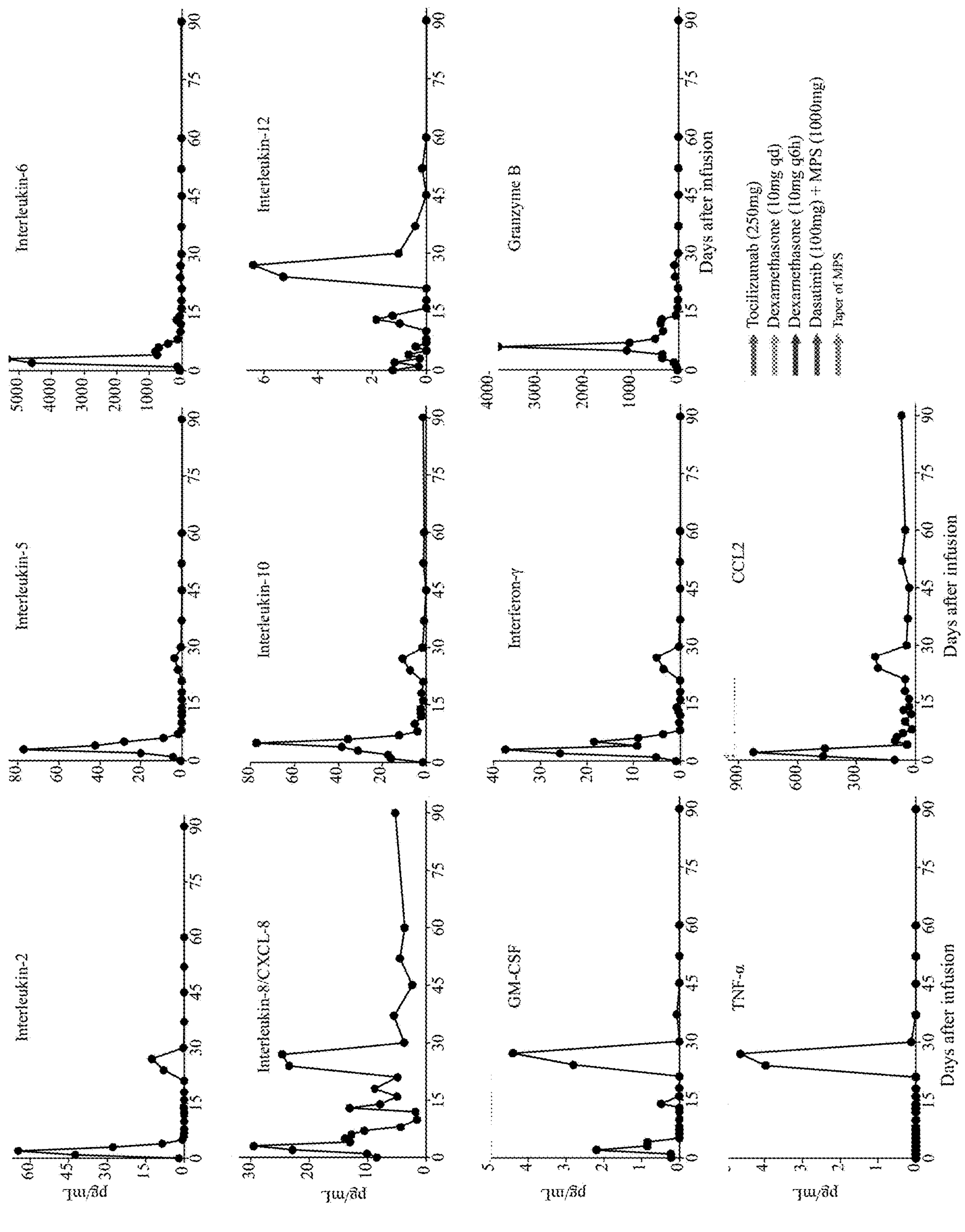
FIG. 70 shows the changes in levels of serum cytokines coincided with the clinical symptoms.

FIG. 70 shows the changes of serum cytokines coincided with the clinical symptoms. The measured serum levels for 11 cytokines increased, of which 8 cytokines levels peaked immediately post infusion from day 2 through day 6. The IL-6 level rose to 5358.56 pg/ml on day 3, which is a100 times over baseline levels. The granzyme B level peaked on day 6 (3811.46 pg/ml) by a factor of more than 150 times from pre-injection baseline levels (on day 0 before infusion). These results show these changes of serum cytokines parallel the clinical symptoms which coincide with the finding of previous trials of CAR T cell therapy for treatment of hematologic malignancies. These observations can be associated with the induction of intratumoral immune response.

Figure 71:
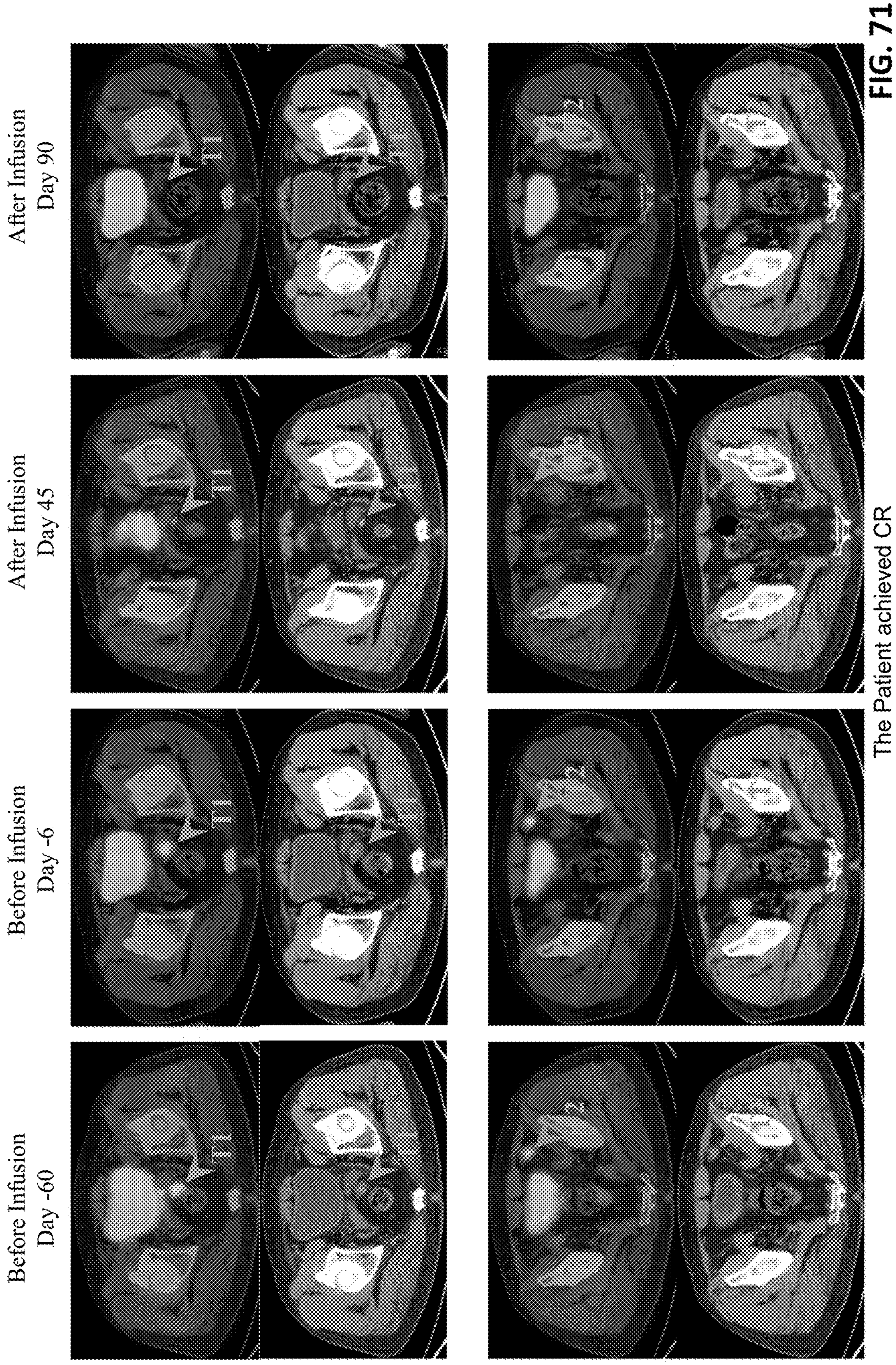
FIG. 71 shows partial and complete remission of all metastatic tumor lesions in patients was subsequently observed at 1.5 and 3 months after treatment, respectively.

FIG. 71 shows partial and complete remission of all metastatic tumor lesions was subsequently observed at 1.5 and 3 months after treatment, respectively. Both target lesions had remarkable reduction in the short axis to <10 mm, fulfilling a "complete remission (CR) of target lesions" according to RECIST (version 1.1) classification. Partial and complete remission of all metastatic tumor lesions was subsequently observed at 1.5 and 3 months after treatment, respectively.

Figure 72:
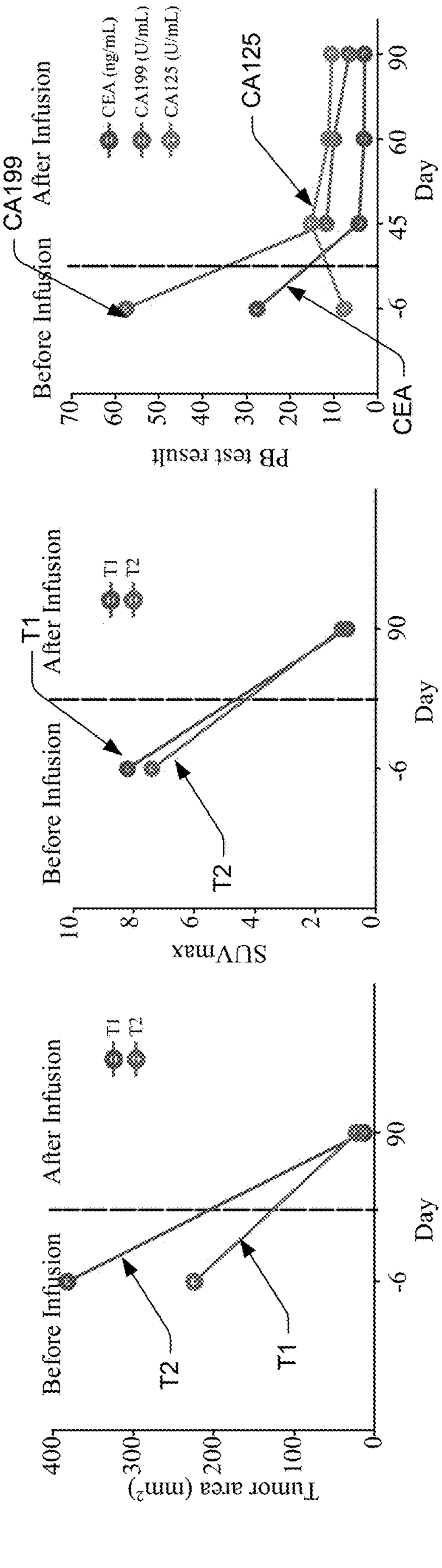
FIG. 72 shows decreased levels of tumor markers suggesting a complete metabolic response associated with GUCY2C CoupledCAR® T therapy.

FIG. 72 shows decreased level of tumor markers indicating a complete metabolic response associated with GUCY2C-CoupledCAR® T therapy. Tumor area of target lesions had remarkable reduction in short axis to <10 mm. The levels of SUVmax decreased to normal range. The levels of tumor markers, including CEA and CA199, decreased to normal range. Small increases in levels of CA125 was observed on day 45, followed by a decrease to normal range. These results suggest that the patient received a good and durable response by GUCY2C-CoupledCAR® T cells.

Figure 73A:
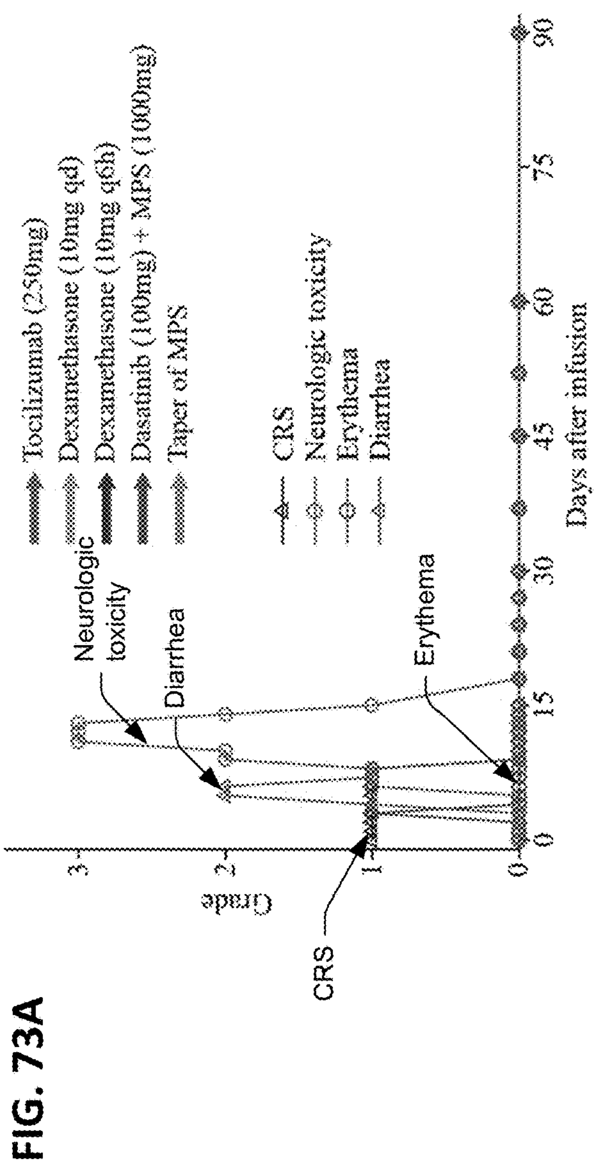
FIGS. 73A-73C show grade 1 cytokine release syndrome (CRS) and grade 2/3 neurological toxicity have resolved.
Figure 73B:
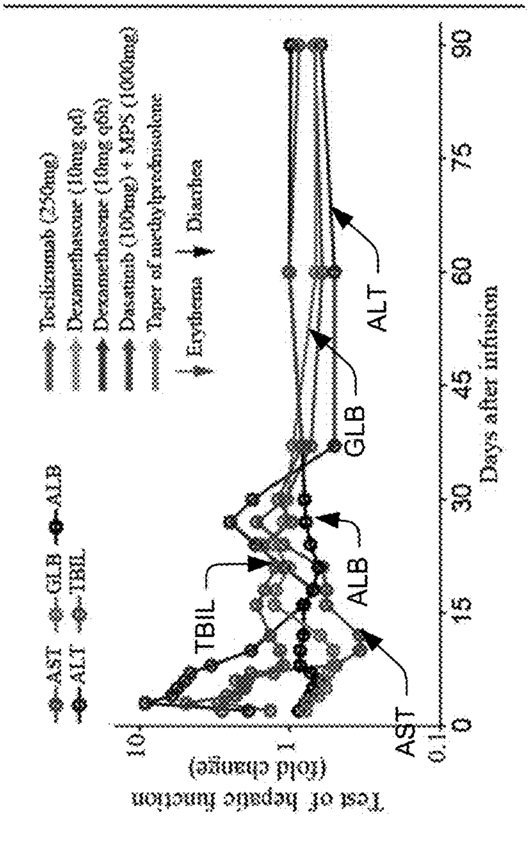
Figure 73C:
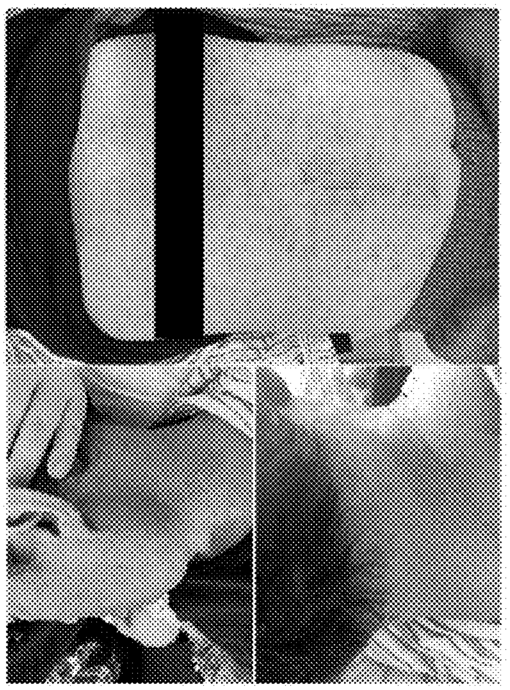

FIG. 73A-73C shows the grade 1 cytokine-release syndrome and grade 2/3 neurological toxicity have resolved. FIG. 73A. Grade 1 CRS and grade 3 neurologic toxicity have resolved through treatment with administration medications at the same time. Hepatic dysfunction had also resolved with the measured levels of aspartate aminotransferase (AST), alanine aminotransferase (ALT), serum globulin (GLB), serum albumin (ALB), and total bilirubin (TBIL) returning to the normal range. FIG. 73C. Erythema with mild symptoms in this study were reversable during treatment. The grade 1 cytokine-release syndrome and grade 2/3 neurological toxicity have resolved. Toxic effects would not be a major impediment to treatment of solid tumor.

Figure 74:
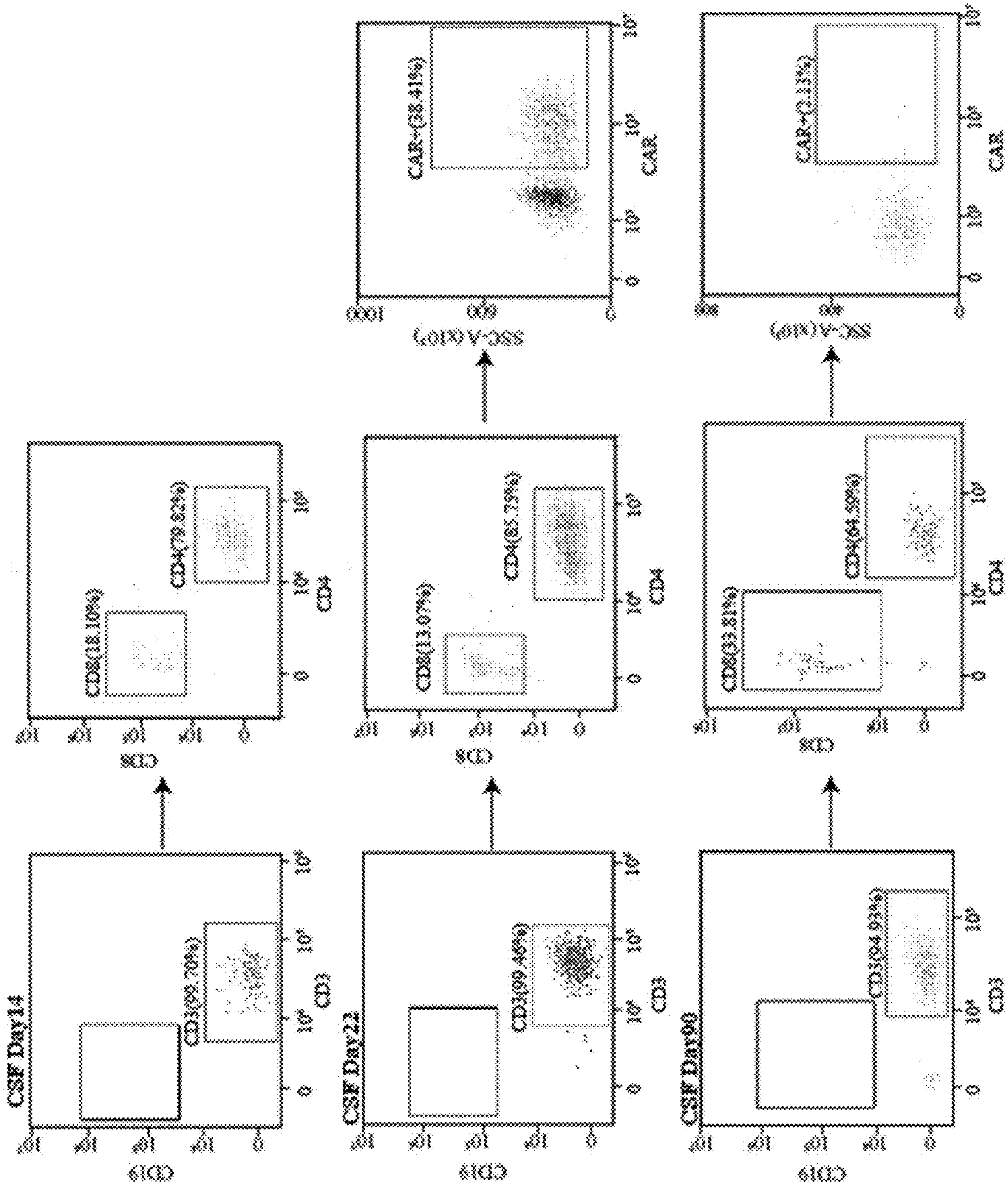
FIGS. 74 and 75 show CAR T cells were observed in the cerebrospinal fluid (CSF), and are decreased when the tumor burden was significantly lower.
Figure 75:
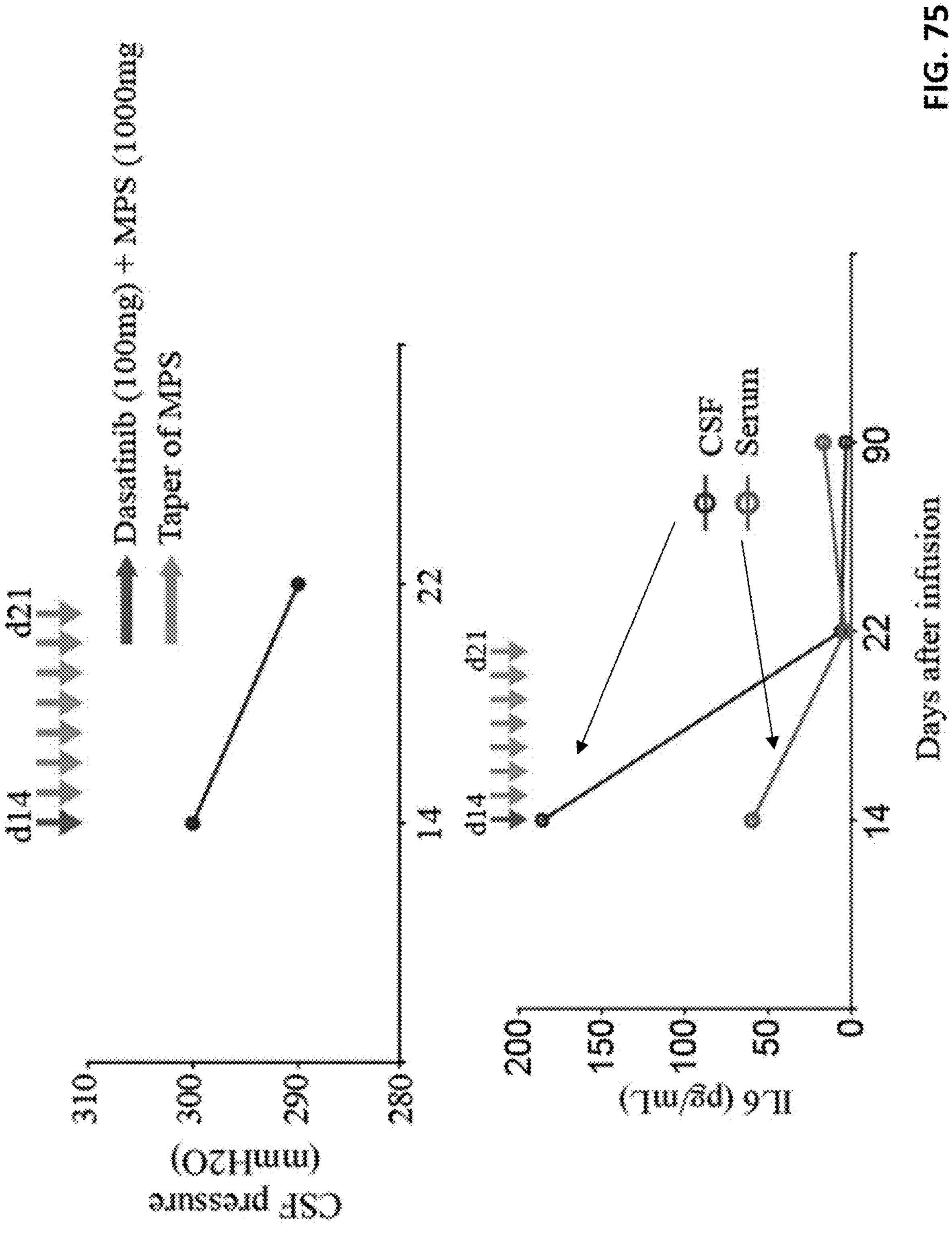

FIGS. 74 and 75 show CAR T cells were observed in the cerebrospinal fluid (CSF). As shown in FIG. 74, The CAR T cells were observed in the cerebrospinal fluid (CSF), and subsequently disappeared on day 90. As shown by lumbar puncture in FIG. 75, the level of cerebrospinal fluid (CSF) decreased on day 22. The IL-6 concentration in CSF declined to 6.00 pg/mL on day 22, which is consistent with the changes in serum IL-6 levels. These results show that therapy-related side-effect due to CD19+ B cells elimination can be reversed.

Figure 76A:
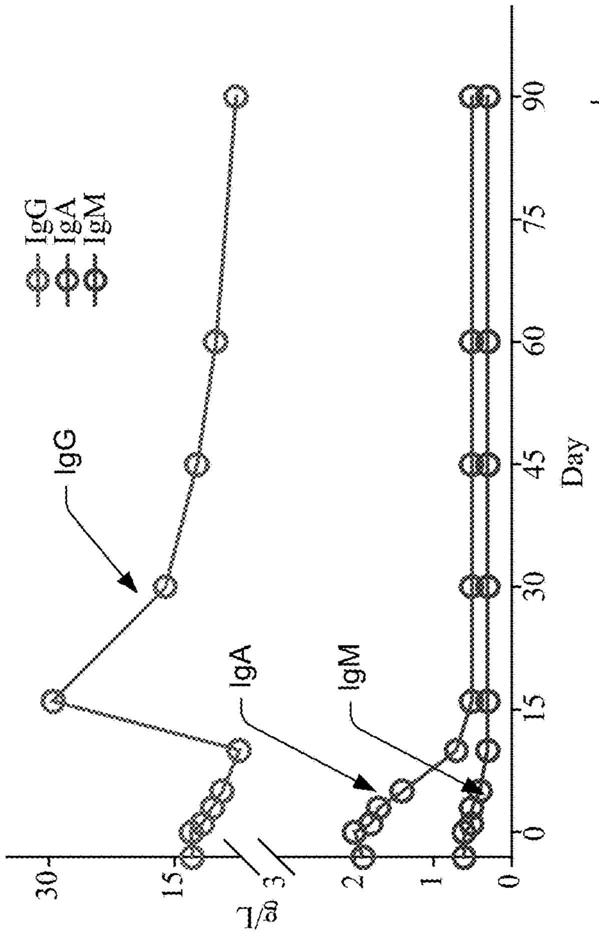
FIGS. 76A-76C show the therapy-related side-effect due to CD19+ B cells elimination (decrease) could be reversed.
Figure 76B:
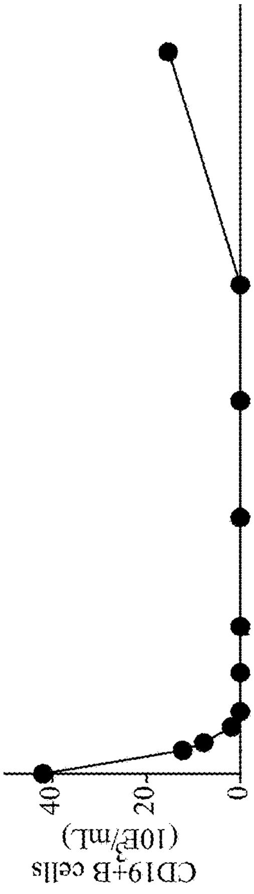
Figure 76C:
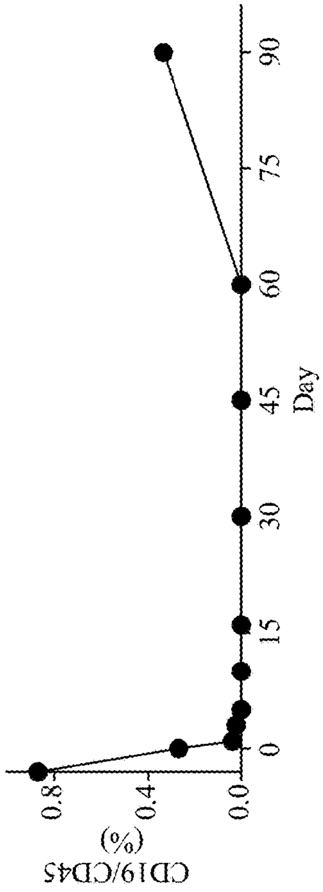

FIGS. 76A-76C shows therapy-related side-effect on CD19+ B cells elimination can be reversed. FIG. 76A. The immunoglobulin levels decreased after CAR T cells infusion, though the levels are still in the normal range. FIGS. 76B and 76C. CD19+ B cells have disappeared on day 5 after CAR T cell infusion and reappear on day 90. Thus, therapy-related side-effect due to CD19+ B cells elimination can be reversed.

CoupledCAR®: T Cell Expansion via CD19 CAR T and B Cells

Figure 82:
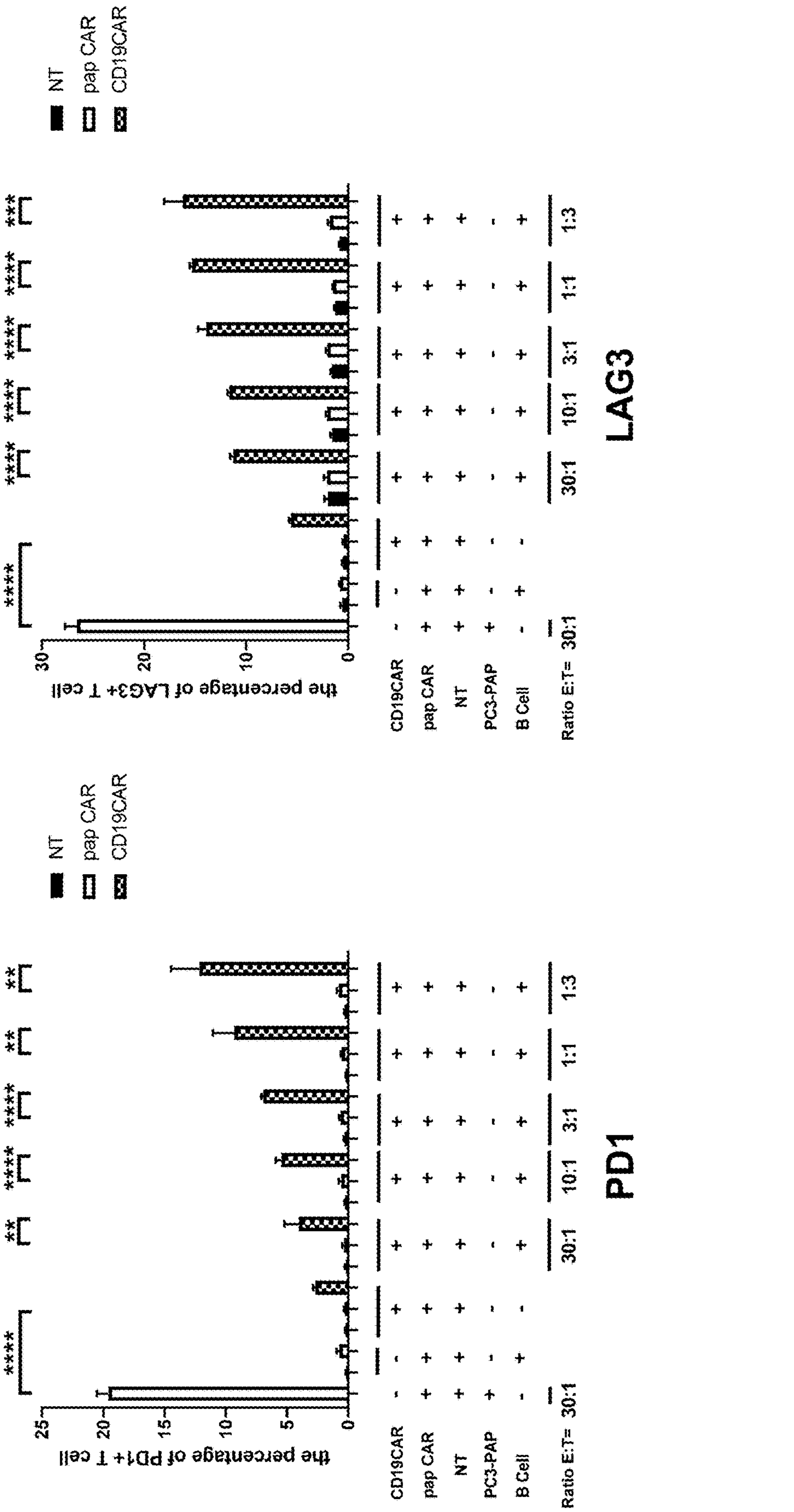
FIG. 82 shows expression of markers for exhaustion on various cells.

FIG. 82 shows the expression of exhaustion markers on various cells. PAP CAR T cells, non-transferred T (NT) cells, and CD19 CART cells were co-cultured with B cells and/or substrate cells, respectively, and the expression of PD1 and Lag3 on these cells were measured (P value<0.05=*, <0.01=, <0.001=*, <0.0001=****; P≥0.05=no significance=NS). Flow cytometry analysis was used to measure exhaustion levels of cells. The results showed that in a CoupledCAR® system, CD19 CAR killed B cells and up-regulated PD1 and LAG3. These markers were not up-regulated in NT cells and PAP CAR T cells as compared to CD19 CART cells, indicating that the stimulation of PAP CART cells in the CoupledCAR® system did not rely on antigens and expanded with little exhaustion.

Figure 83:
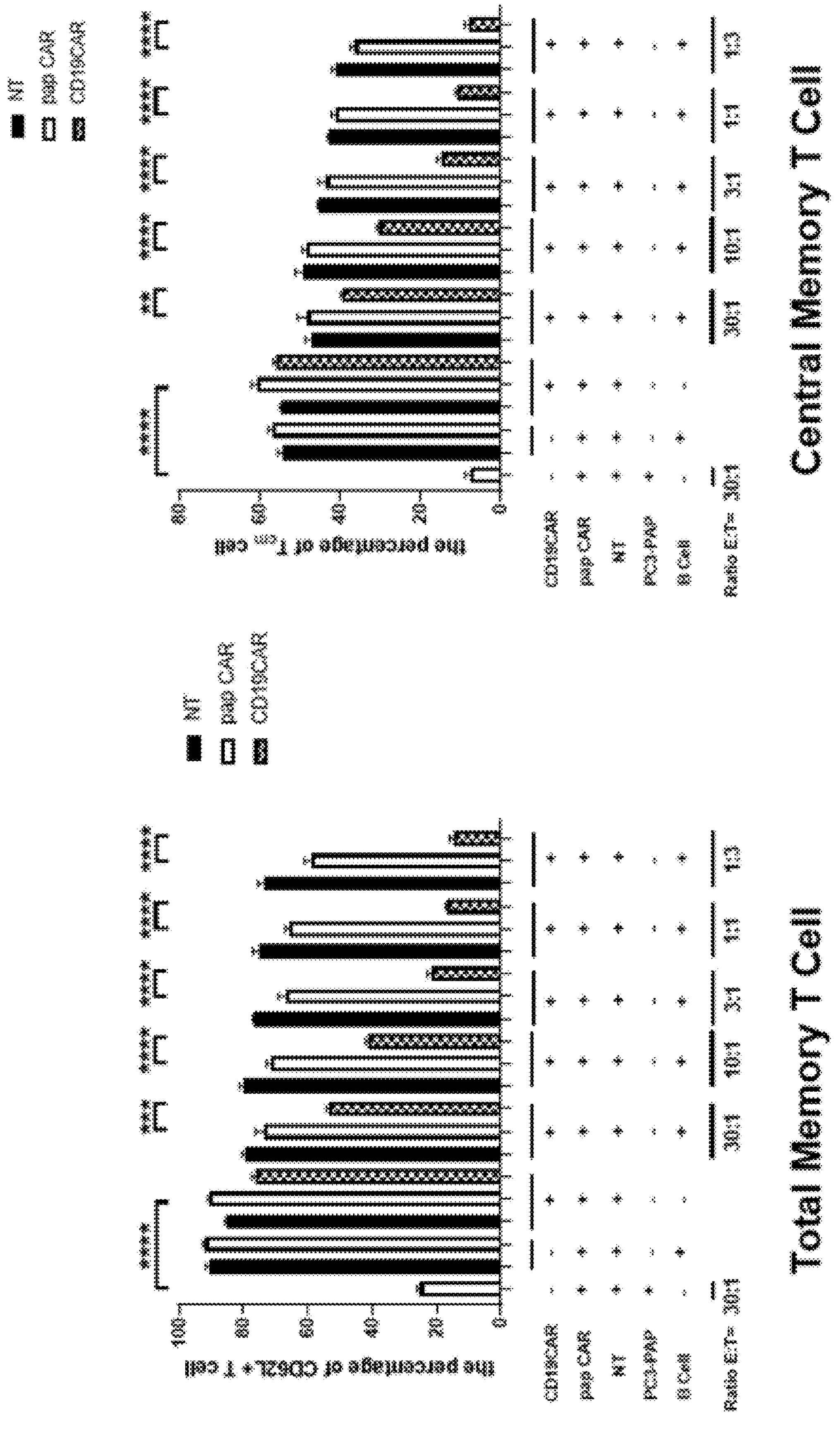
FIGS. 83, 84, and 85 show proportion of memory T cells, central memory T (Tcm) cells, and stem like central memory T (Tscm) cells of various cells cultured as described in FIG. 82.
Figure 84:
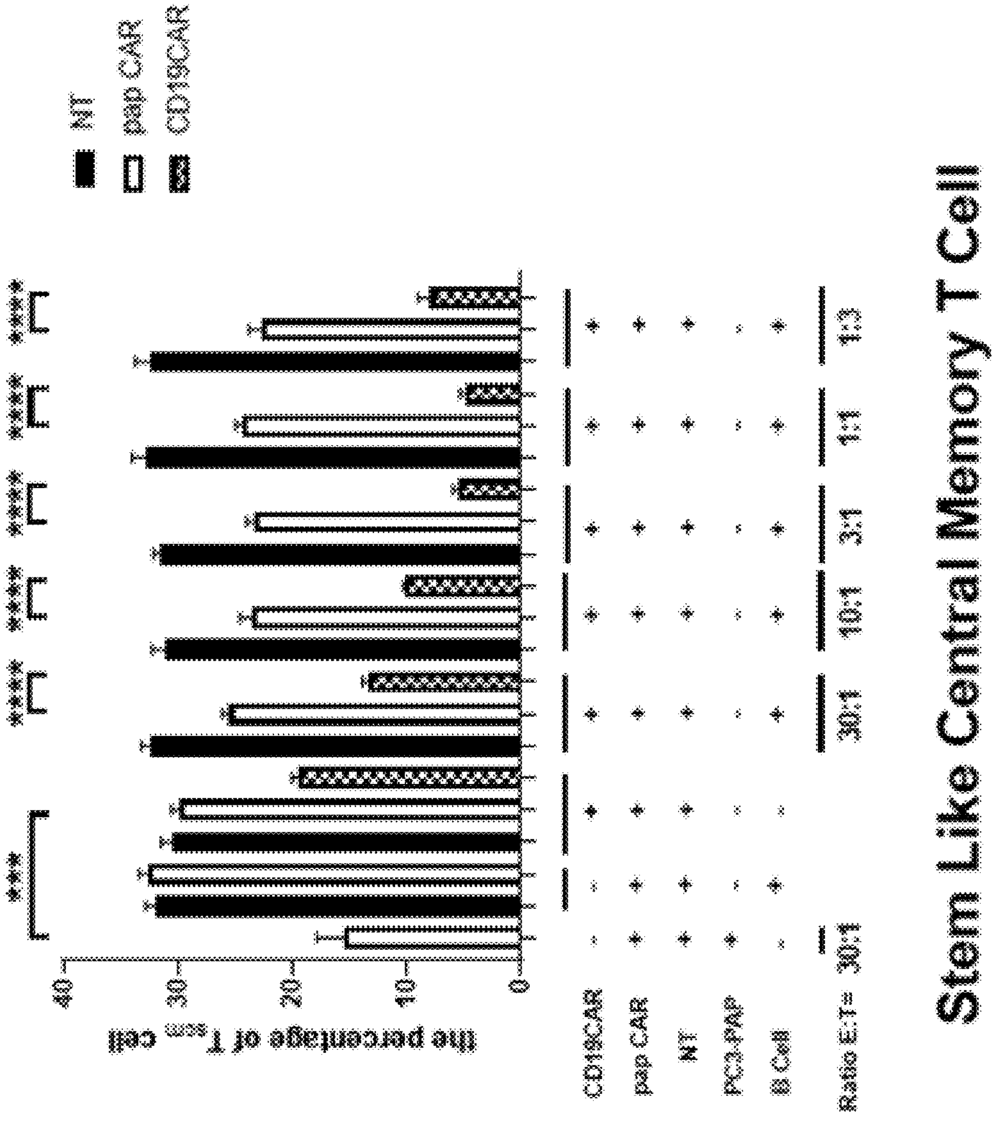
Figure 85:
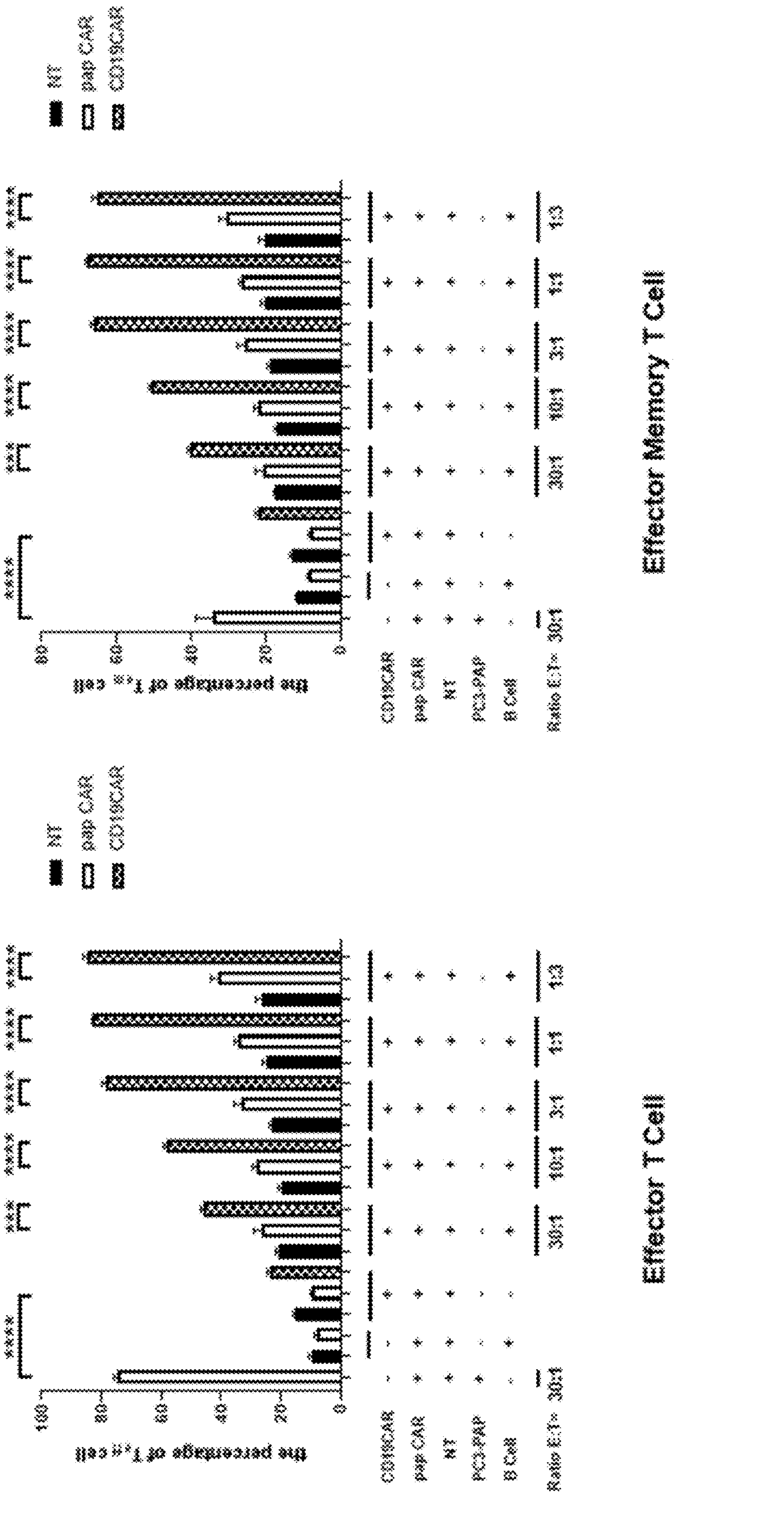

FIGS. 83-85 show the proportion of memory T cell, central memory T (Tcm) cell and stem like central memory T (Tscm) cell of various cells cultured as described in FIG. 82 (P value<0.05=*, <0.01=, <0.001=*, <0.0001=****; P≥0.05=no significance=NS). Flow cytometry analysis results showed that in the CoupledCAR® system, CD19 CART cells were differentiated into effector cells by killing B cells while few memory cells were observed. PAP CAR T cells and NT cells were not differentiated into effector cells and maintain a high proportion of memory cells and memory cells with stem cell phenotypes. Thus, the CoupledCAR® system helped PAP CAR T cells maintain high differentiation potential until contact with solid tumors.

Figure 86:
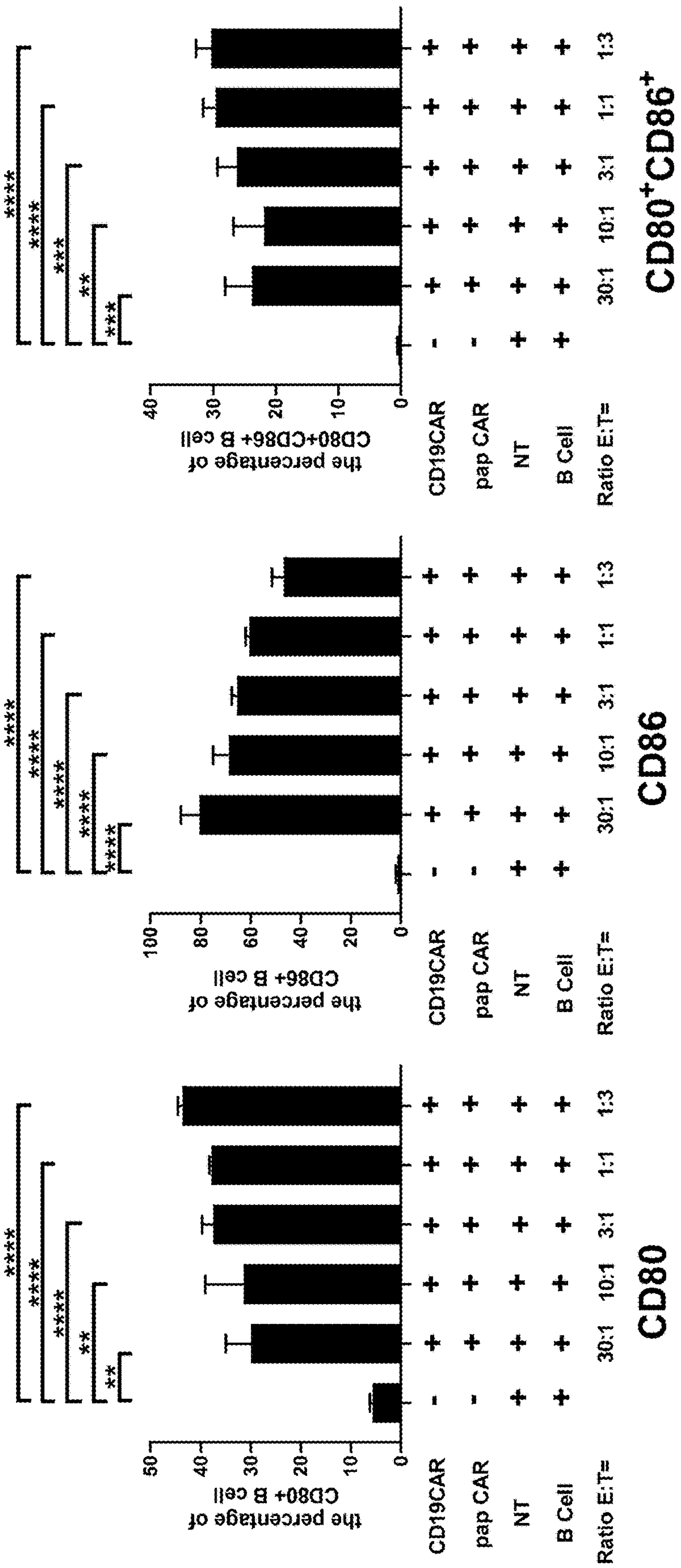
FIG. 86 shows activation of B cells that are cultured with various cells.

FIG. 86 shows activation of B cells that are cultured with various cells (P value<0.05=*, <0.01=, <0.001=*, <0.0001=****; P≥0.05=no significance=NS). Flow cytometry results showed that the expression of CD80 and CD86 are up-regulated on B cells. CD80 and CD86 are expressed as cell surface molecules by APCs (e.g., B cells) and are responsible for delivering signals to T cells. For example, along with CD80, CD86 provides costimulatory signals necessary for T-cell activation and survival. Thus, in the CoupledCAR® system, B cells are also activated, and these activated B cells interact with T cells by providing signals (e.g., costimulatory signals) to enhance T cell activation and/or expansion and survival.

These results show that, in the CoupledCAR® system, CD19 CAR up-regulated expression inhibition markers such as PD1 and LAG3 after activation of CAR-mediated TCR. But surprisingly, little of these inhibition markers were expressed on PAP CAR T and NT cells. Moreover, compared with CD19 CART cells, PAP CAR T and NT cells inhibited more phenotypes of Tscm and Tcm cells and fewer phenotypes of effector cells. Also, CoupledCAR® did not significantly reduce the number of memory cells of PAP CAR T and NT cells as compared to a non-coupled CAR system. In hematological malignancies, CAR T cells are directed against lineage antigens of B cells and encounter the antigens on normal and malignant B cells of the subject. These B cells act as antigen-presenting cells (APCs) that provide strong proliferation signals to expand CAR T cells and lead to persistence of CAR T cells. These results demonstrate the role of B cells in the CoupledCAR® system and indicate that CAR T cells targeting another B cell antigen (e.g., BCMA, CD22, CD20, etc.) may replace CD19 CART cells in a CoupledCAR® system (CD19 CART and PAP CART cells) as descried in FIGS. 82-86.

Figure 98:
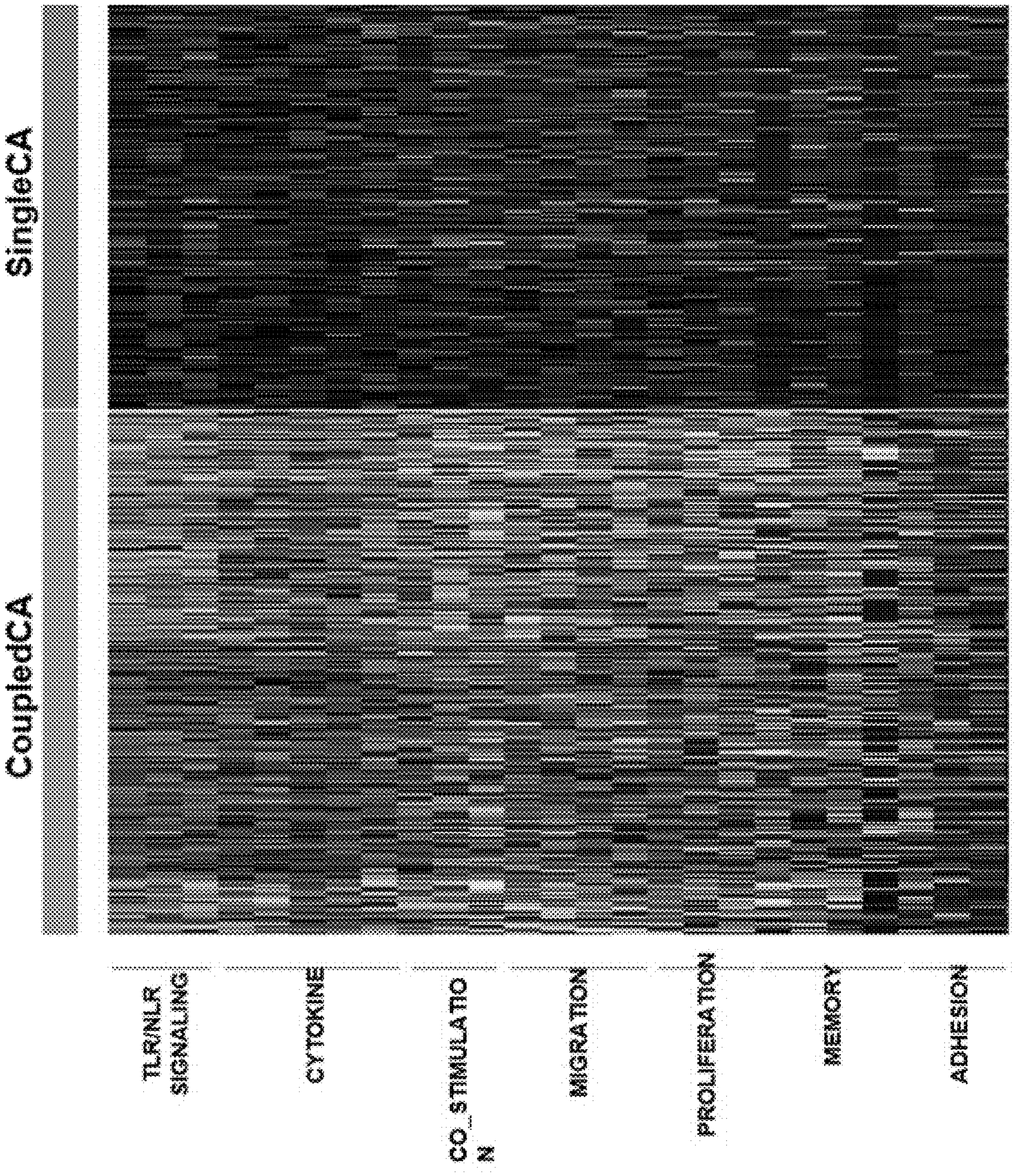
FIGS. 98 and 99 show gene set profiling results of scRNA analysis.
Figure 99:
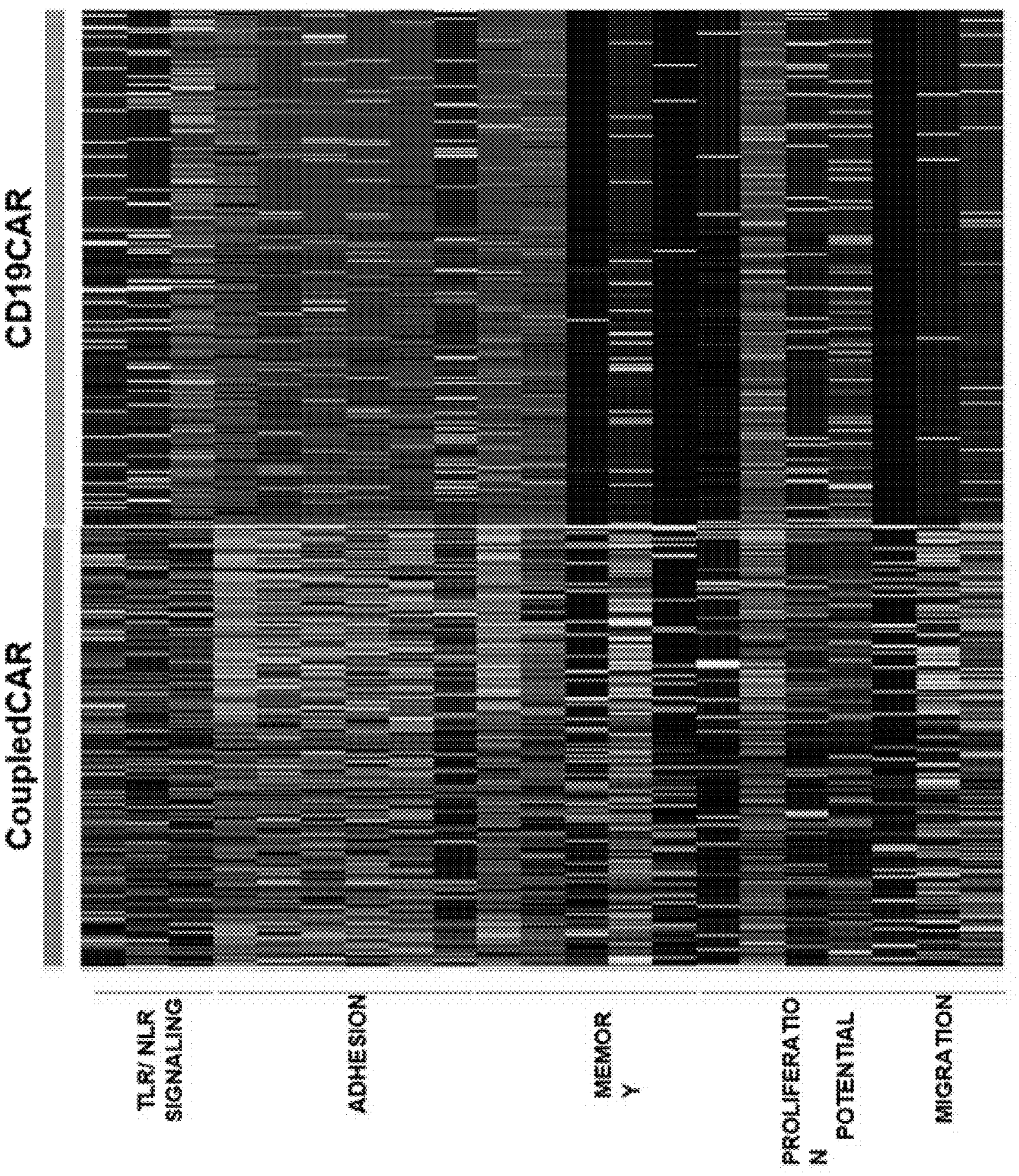

Further, single cell RNA (scRNA) analysis was performed on CD19 CART cells and PAP CART cells. As compared to CD19 CART cells, the proliferating PAP CART cells showed stronger cytokine production, as well as less exhaustion and higher memory-like and trafficking profiles. FIGS. 98 and 99 show gene profiling results of scRNA analysis. FIG. 98 shows PAP CAR T cells in the CoupledCAR® system are characterized by enriched TLR/NLR signaling, functionality, co-stimulation, migration, proliferation, adhesion, and memory related gene sets as compared to Control (no CD19 CAR T cells). FIG. 99 shows PAP CART cells in the CoupledCAR® system are characterized by enriched TLR/NLR signaling, adhesion, memory, proliferation potential, and migration related gene sets as compared to CD19 CART cells in the CoupledCAR® system. These results demonstrate that CoupledCAR® enhance the T cells capabilities to inhibit tumor growth, maintain persistence in blood of a subject having cancer and/or tumor microenvironment, infiltrate tumor microenvironment, increase adhesion, and maintain memory-like status before contacting target antigens.

T Cell Expansion via Bispecific Antibody and B Cells

On day 0, the peripheral blood of healthy volunteers was drawn, and CD3+ T cells were sorted with Pan T Kit. 100 ul of T cell Transact™ (for activating and expanding human T cells via CD3 and CD28) were added per $1\times10^7$ T cells. On day 1, $4\times10^6$ 1234 T cells were transduced with lentivirus vector encoding CD19 CAR (Table 10), and multiplicity of infection (MOI) is 10. $4\times10^6$ 6503 T cells were transduced with lentivirus vectors encoding PAP CAR (Table 10), and the MOI is 49.98. $4\times10^6$ T cells were non-transduced T cells (NT cells). On day 2, the media were changed to remove lentivirus vectors and T cell TransAct™.

TABLE 10

| Name | Construction | Notes |
| --- | --- | --- |
| 1234 | CAR-h19-bbz | Humanized CD19 scFv and 4-1BB |
| 6503 | CAR-ACPP-bbz | ACPP (or PAP) scFv and 4-1BB |

Figure 88:
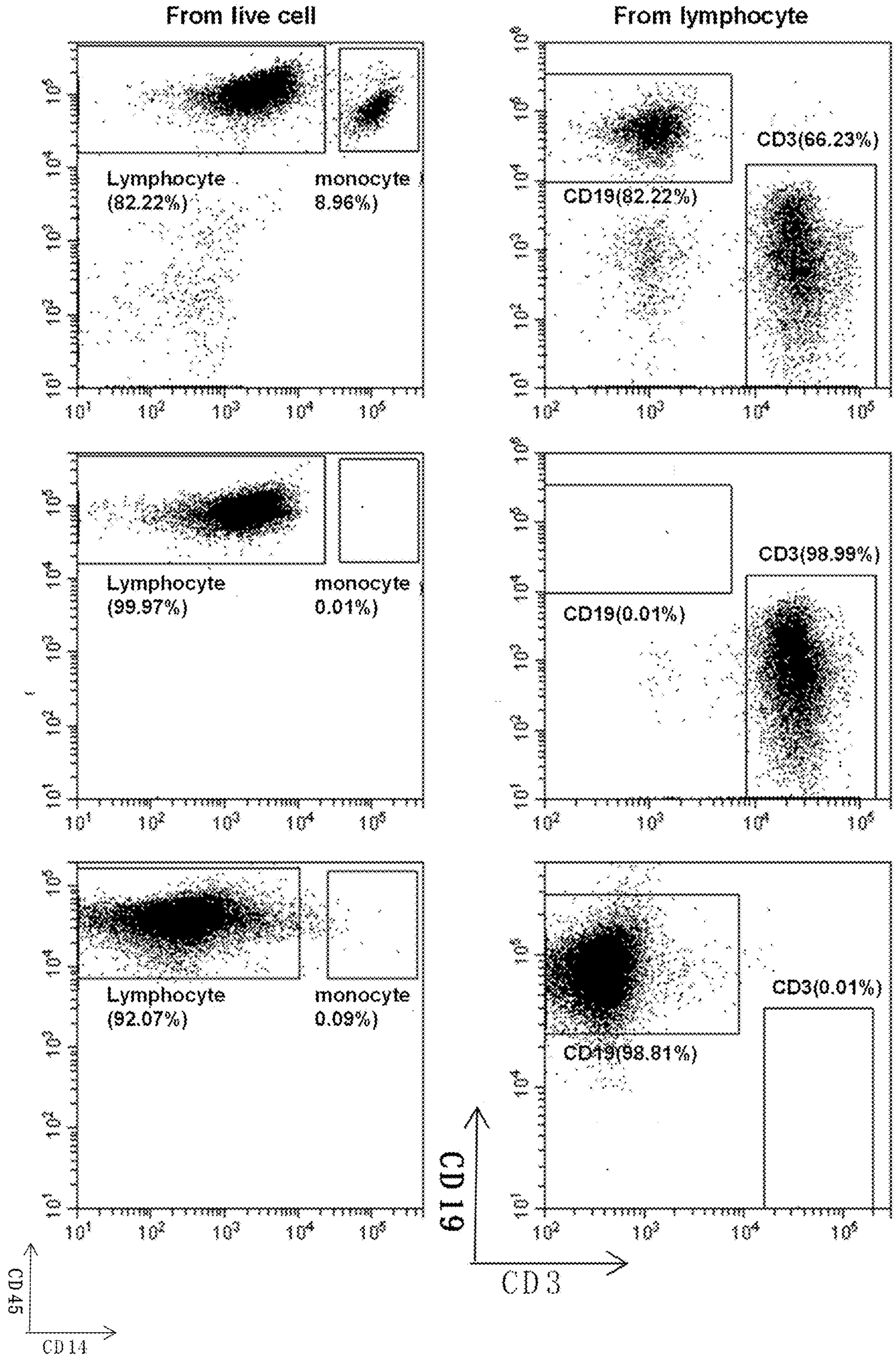
FIG. 88 shows flow cytometry results of sorting of B cells and T cells.
Figure 89:
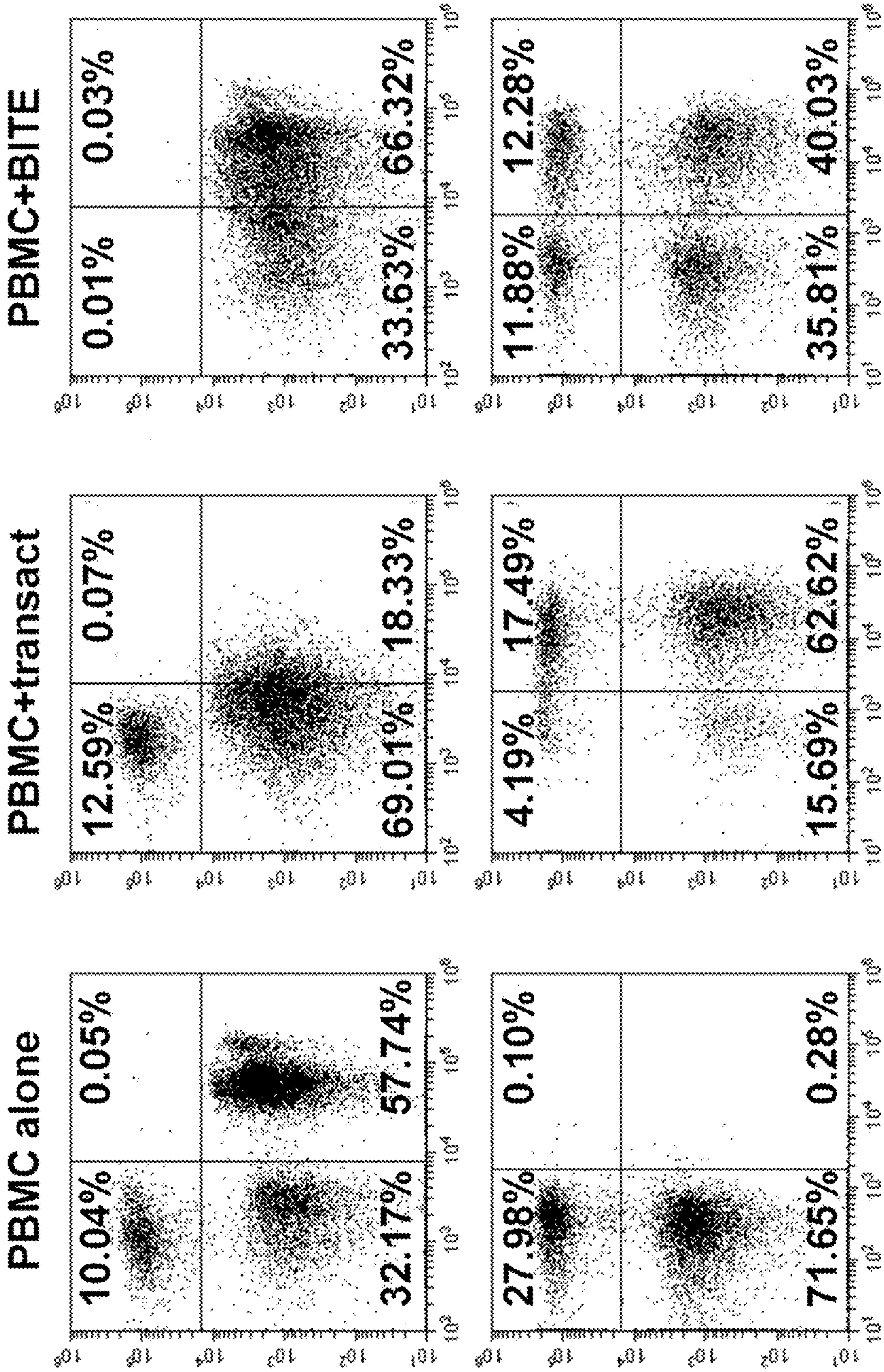
FIGS. 89 and 90 show flow cytometry results of expression of cell markers of co-cultured cells including B cells and T cells in the presence or absence of CD3-CD19 bispecific antibody
Figure 90:
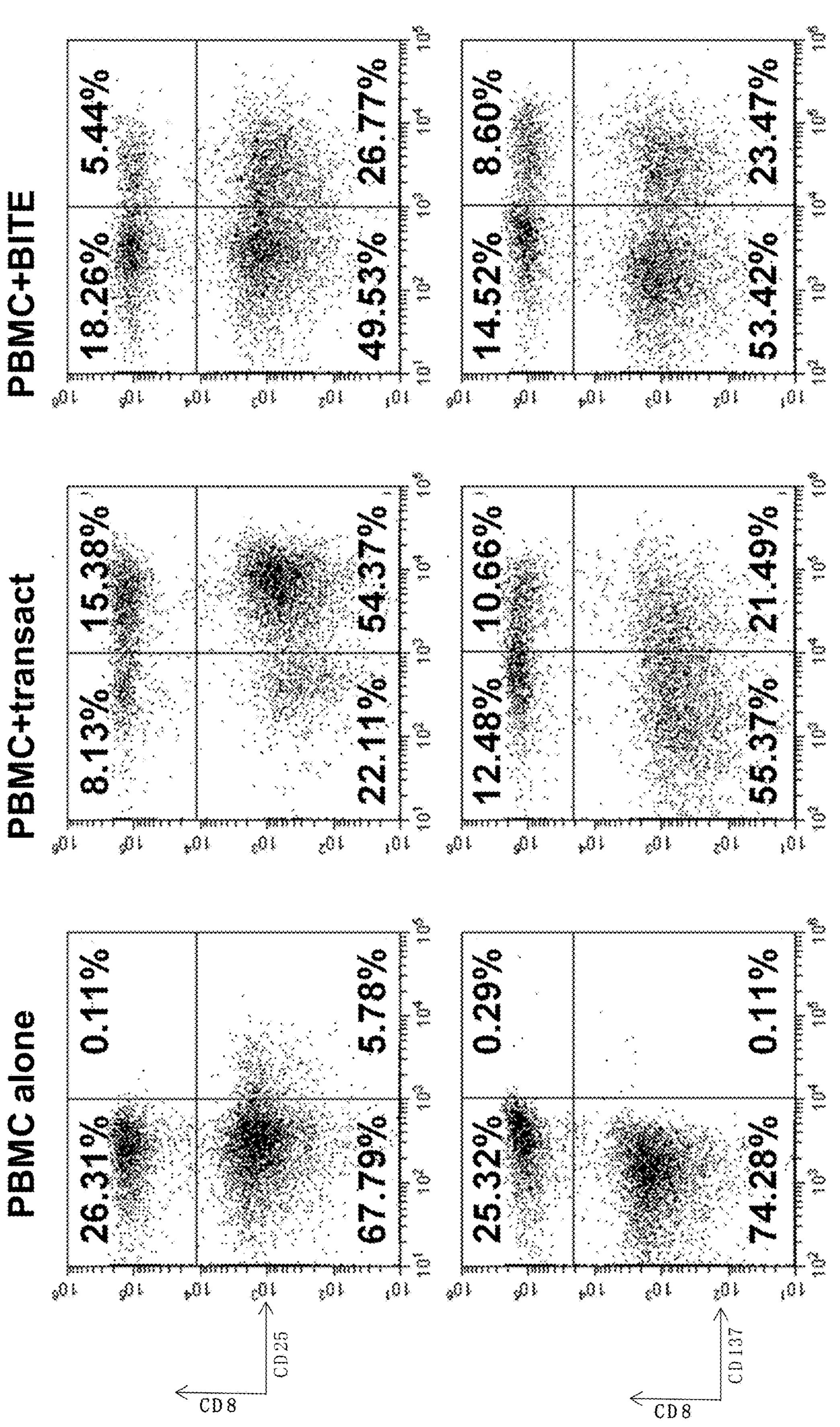
Figure 91:
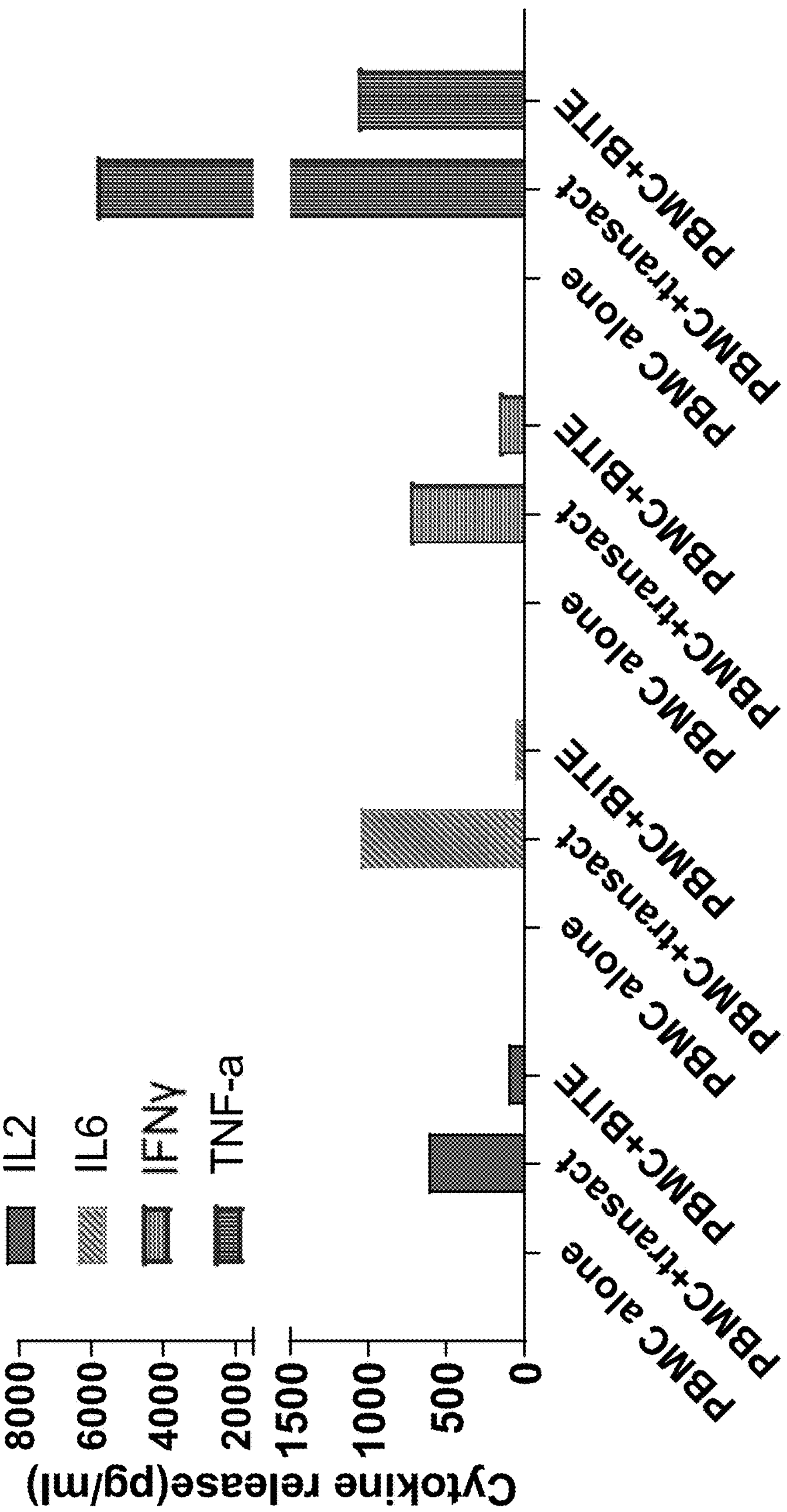
FIG. 91 shows flow cytometry cytokine results of cytokine release in experiments described in FIGS. 89 and 90.

FIG. 88 shows flow cytometry results of sorting of B cells and T cells. FIGS. 89 and 90 show flow cytometry results of expression of cell markers of co-cultured cells including B cells and T cells in the absence and presence of CD3-CD19 bispecific antibody (CD3-CD19 bispecific antibody), which was purchased from Biointron (catalog number of B302001). FIG. 91 shows flow cytokine results of cytokine release in the experiments of FIGS. 89 and 90. These results show CD3 positive T cells and CD19 positive B cells are connected via CD3-CD19 bispecific antibody, resulting in activation of T cells and cytokine release to lyse B cells.

Figure 92:
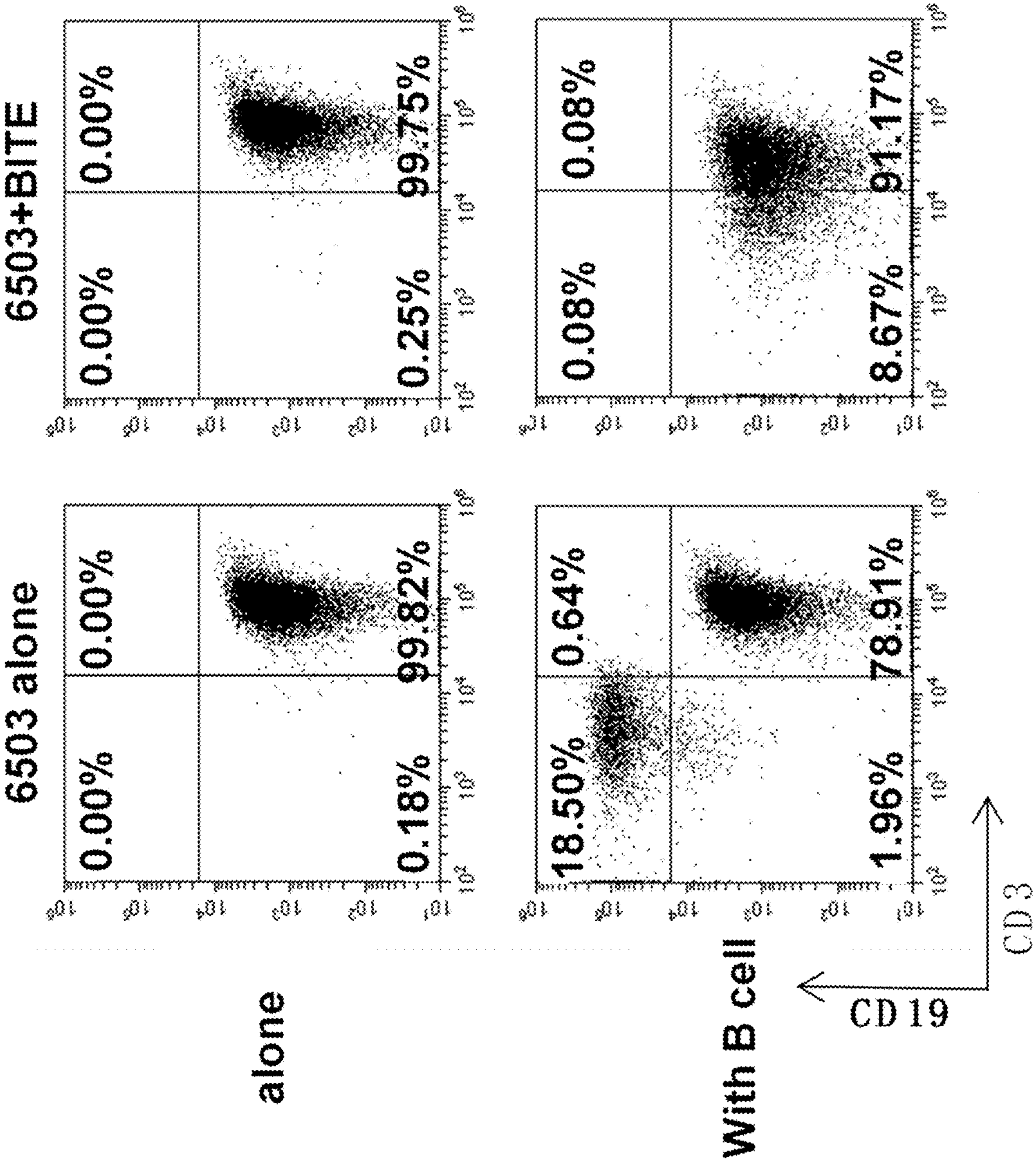
FIG. 92 shows flow cytometry results of PAP CAR T cells co-cultured with B cells in the presence or absence of CD3-CD19 bispecific antibody. PAP CAR T cells were generated and cultured for 7 day.
Figure 93:
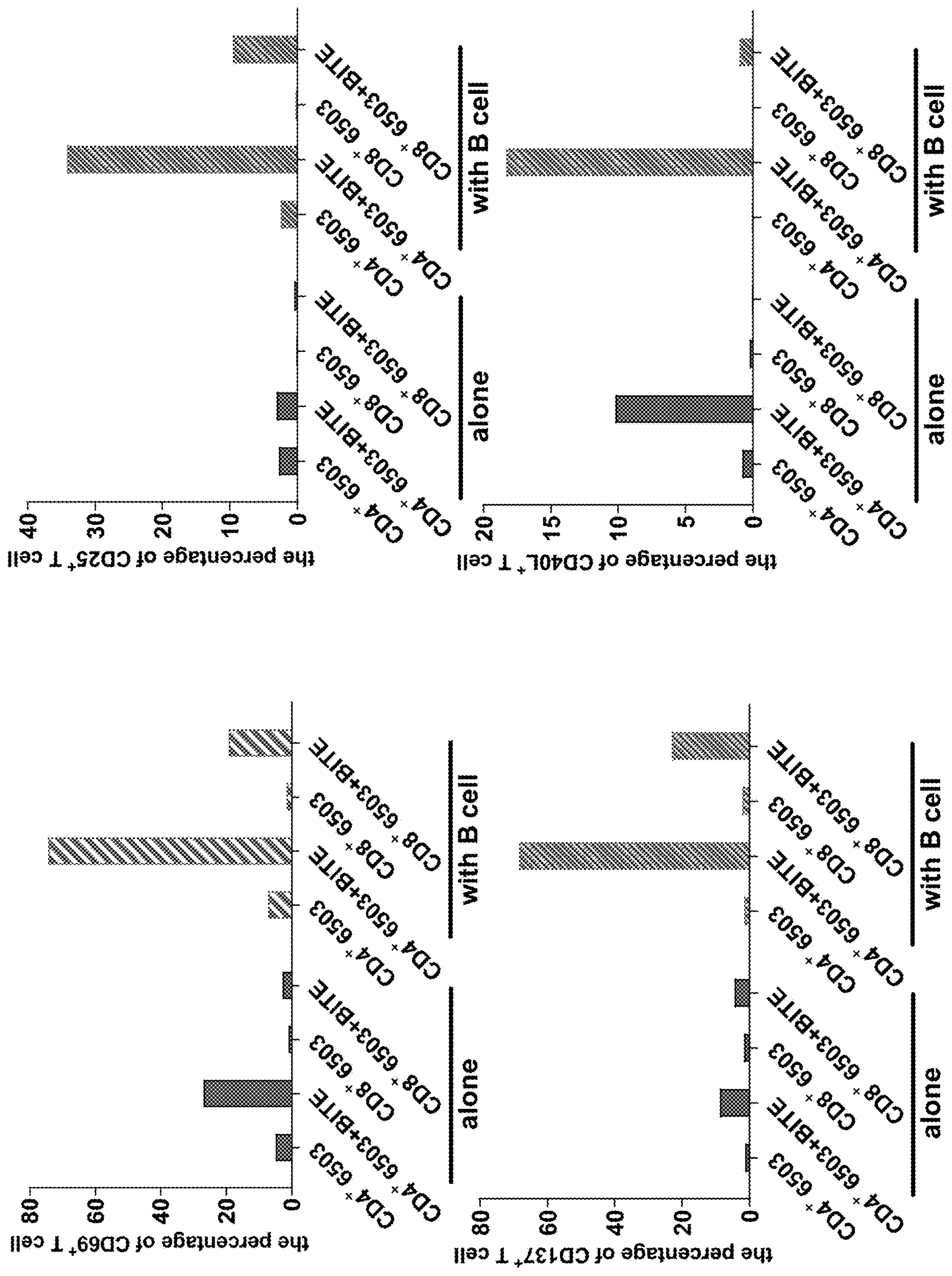
FIG. 93 shows histograms of flow cytometry results of expression of various markers on T cells and B cells in experiments described in FIG. 92.

FIG. 92 shows flow cytometry results of PAP CAR T cells co-cultured with B cells with or without the presence of CD3-CD19 bispecific antibody. PAP CAR T cells were generated and cultured for 7 days. B cells were isolated from PMBCs. CD3-CD19 bispecific antibody was mixed with PAP CAR T cells or PAP CAR T cells co-cultured with B cells. It was observed that after 6503 cells mixed with CD3-CD19 bispecific antibody killed B cells, 6503 cells appeared to be activated. FIG. 93 shows histograms of flow cytometry results of expression of various markers on T cells and B cells in the experiments of FIG. 92. PAP CAR T cells were further co-cultured with B cells for 24 hours, and flow cytometry was used to detect the cell membrane markers. It was observed that 6503 cells co-cultured with or without B cells did not appear to be activated. However, when CD3-CD19 bispecific antibody was added to the media, 6503 cells co-cultured with B cells were activated. 6503 cells alone mixed with CD3-CD19 bispecific antibody showed some activation, which might be caused by T cell Transact™ used in the transduction of lentivirus vectors into T cells to generate 6503 cells. Thus, these results show that CD3-CD19 bispecific antibody can cause solid tumor CART cells (e.g., PAP CART cells) to be activated, as CD19 CAR T cells were in the previous Examples. The activation of PAP CAR T cells was indicated by the expression of CD69, CD25, and CD137 on CD4 and CD8 subtype T cells, which was significantly increased. Also, CD40L expression of CD4 subtype T cells was up-regulated such as to allow these T cells to receive stimulation of CD40 positive APC cells. The amount of CD3-CD19 bispecific antibody is controllable; thus, these results indicate that CD3-CD19 bispecific antibody can cause the controllable activation of T cells by connecting and/or by narrowing the distance between T cells and B cells.

Figure 94:
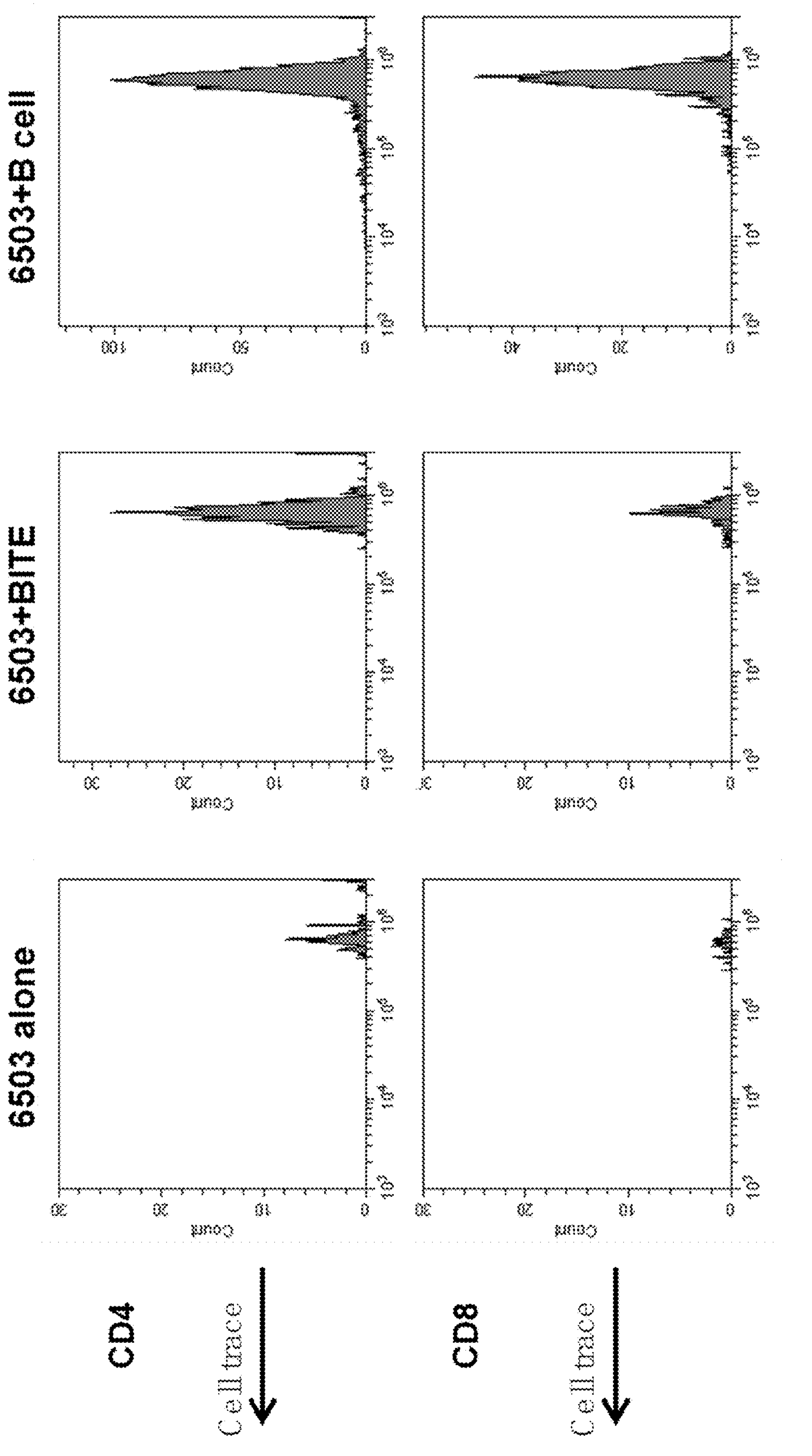
FIGS. 94, 95, and 96 show CellTrace™ analysis of 6503 cells co-cultured with B cells in the presence or absence of CD3-CD19 bispecific antibody.
Figure 95:
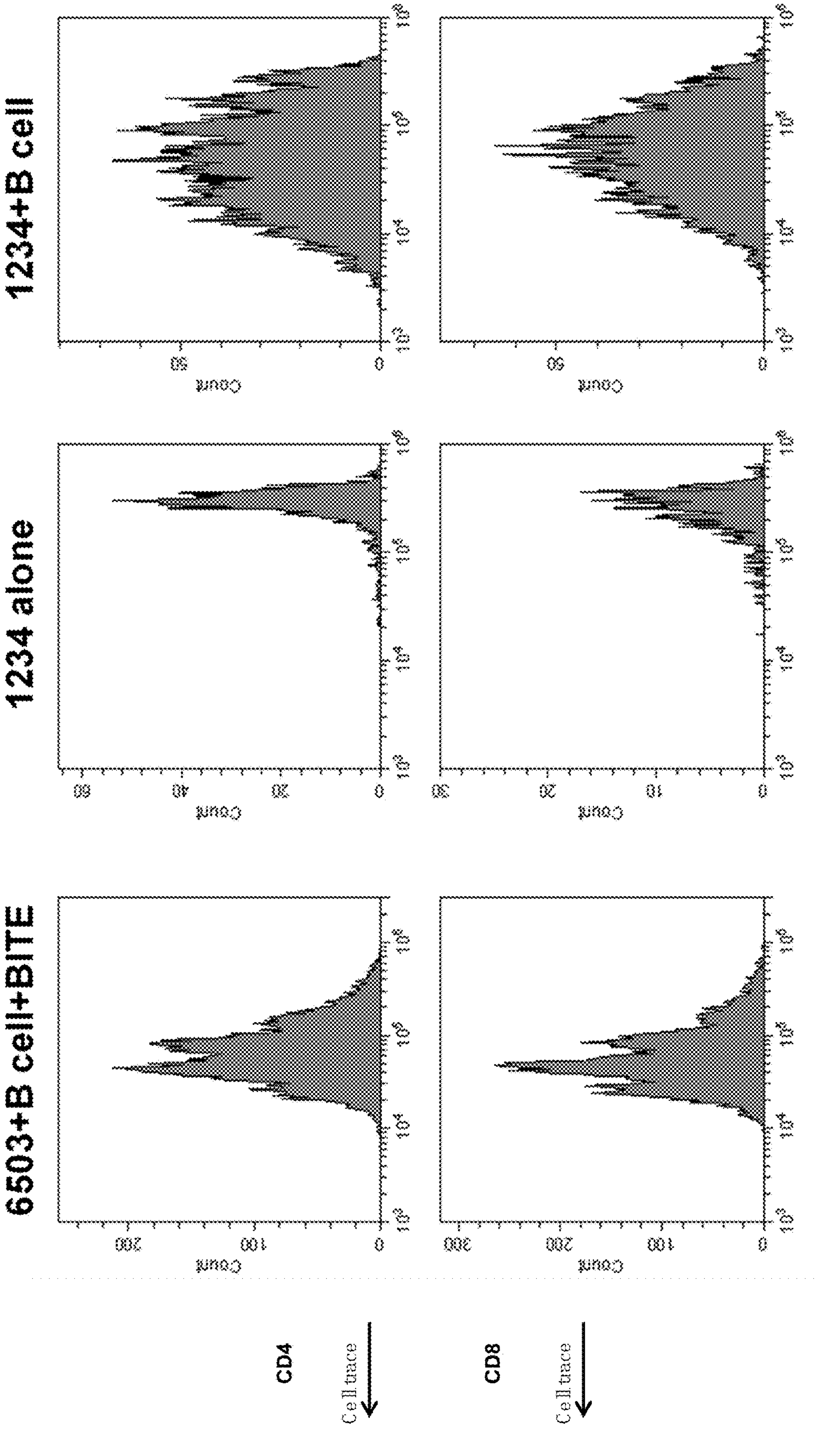
Figure 96:
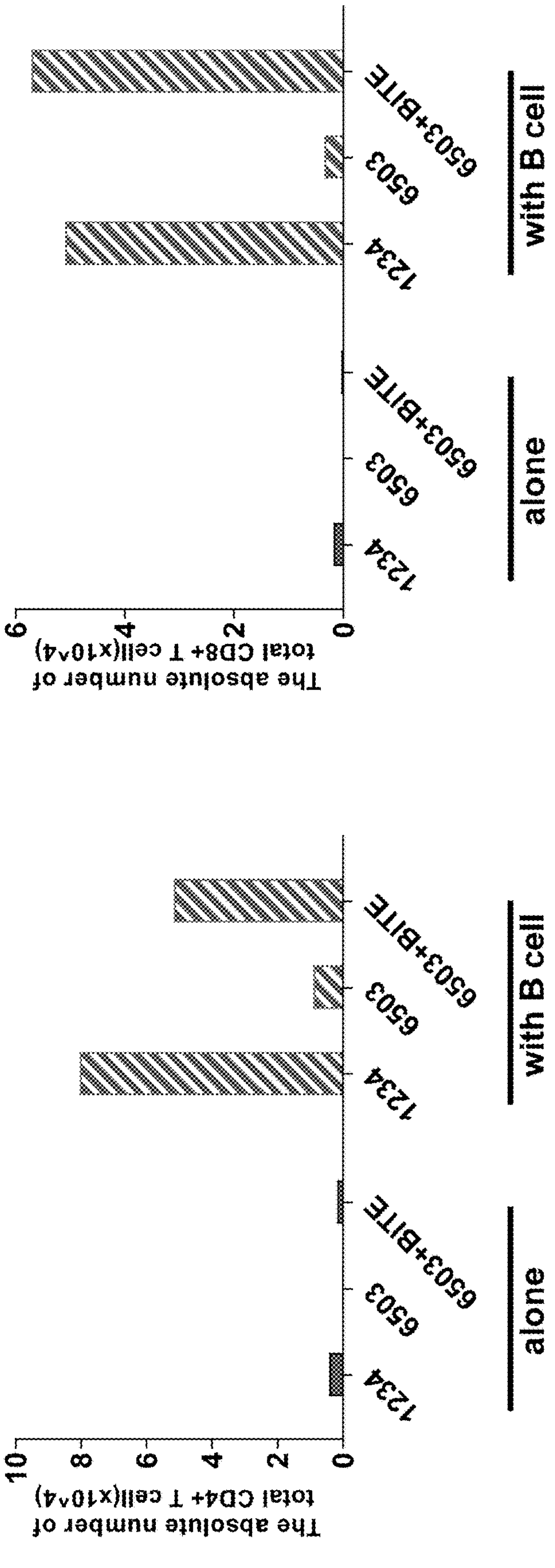

FIGS. 94-96 show CellTrace™ analysis of 6503 cells co-cultured with B cells with or without the presence of CD3-CD19 bispecific antibody. 6503 cells along or co-cultured with B cells mixed with CD3-D19 bispecific antibody for 120 hours, and cell proliferation analysis was performed using CellTrace™. 1234 cells were used as a positive control. It was observed that neither bispecific antibody nor B cells alone could expand T cells, while CD3-CD19 bispecific antibody caused T cells co-cultured with B cell to be expanded.

Figure 97:
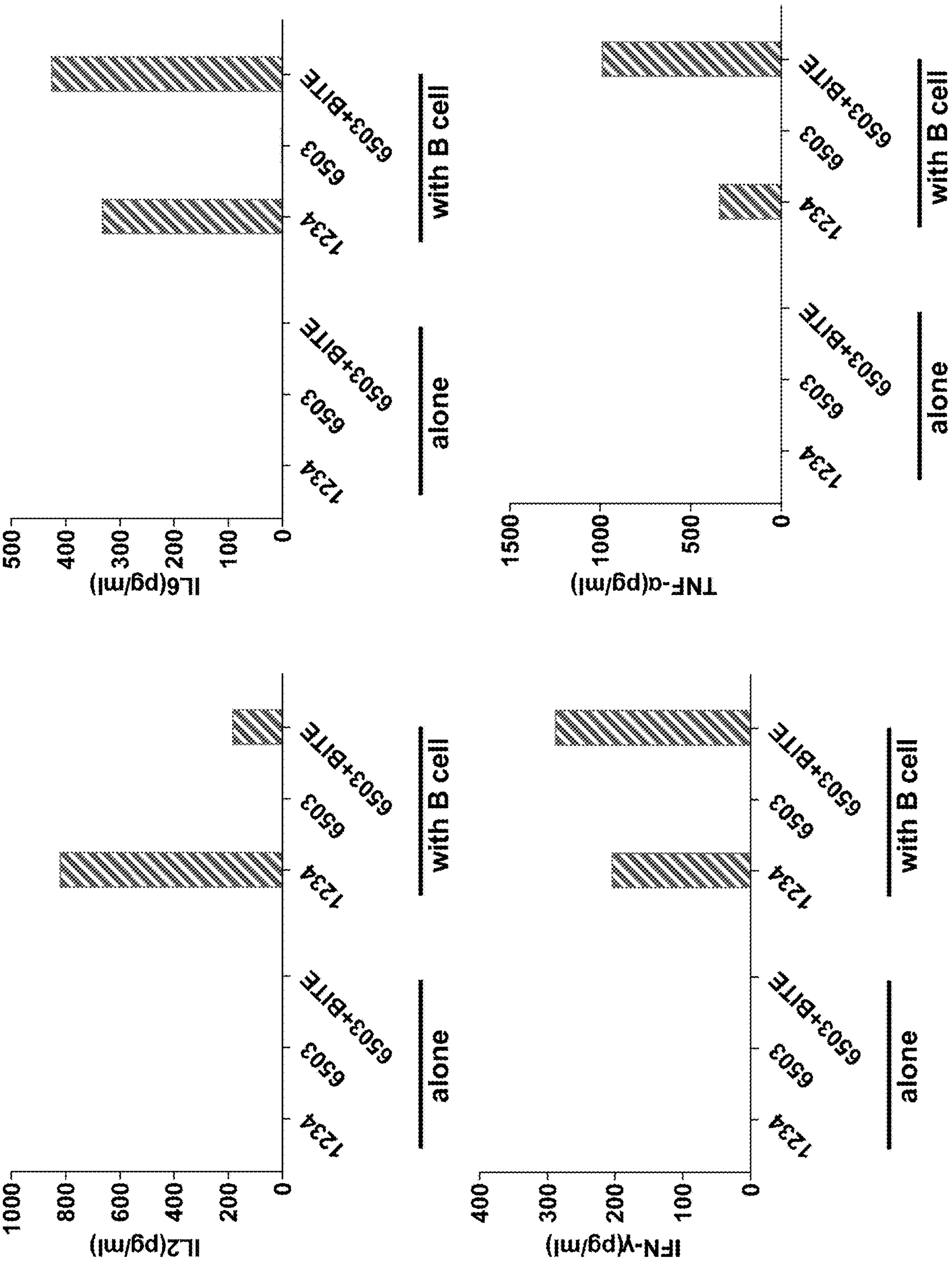
FIG. 97 shows cytokine release results of CAR T cells co-cultured with B cells in the presence or absence of CD3-CD19 bispecific antibody.

FIG. 97 shows cytokine release results of CAR T cells co-cultured with B cells in the absence and presence of CD3-CD19 bispecific antibody. 6503 cells alone or co-cultured with B cells were mixed with CD3-CD19 bispecific antibody for 24 hours and then were analyzed using Cytometric Bead Array (CBA). 1234 cells were used as a positive control. It was observed that neither CD3-CD19 bispecific antibody alone nor B cells alone could make 6503 cells release cytokines, while 6503 cells co-cultured with B cells and CD3-CD19 bispecific antibody released cytokines. For example, the released cytokines included IL2 to promote activation and proliferation of T cells, and IL6, TNF-α, and IFN-γ to provide an inflammatory environment. Thus, these results show that CD3-CD19 bispecific antibody can cause solid tumor CART cells (e.g., PAP CART cells) to be expanded, as CD19 CART cells were in the previous Examples.

Figure 100:
FIG. 100 shows B cell clustering 24 hours after CD19 CART cells and PAP CAR T cells were co-cultured with these B cells.
Figure 101:
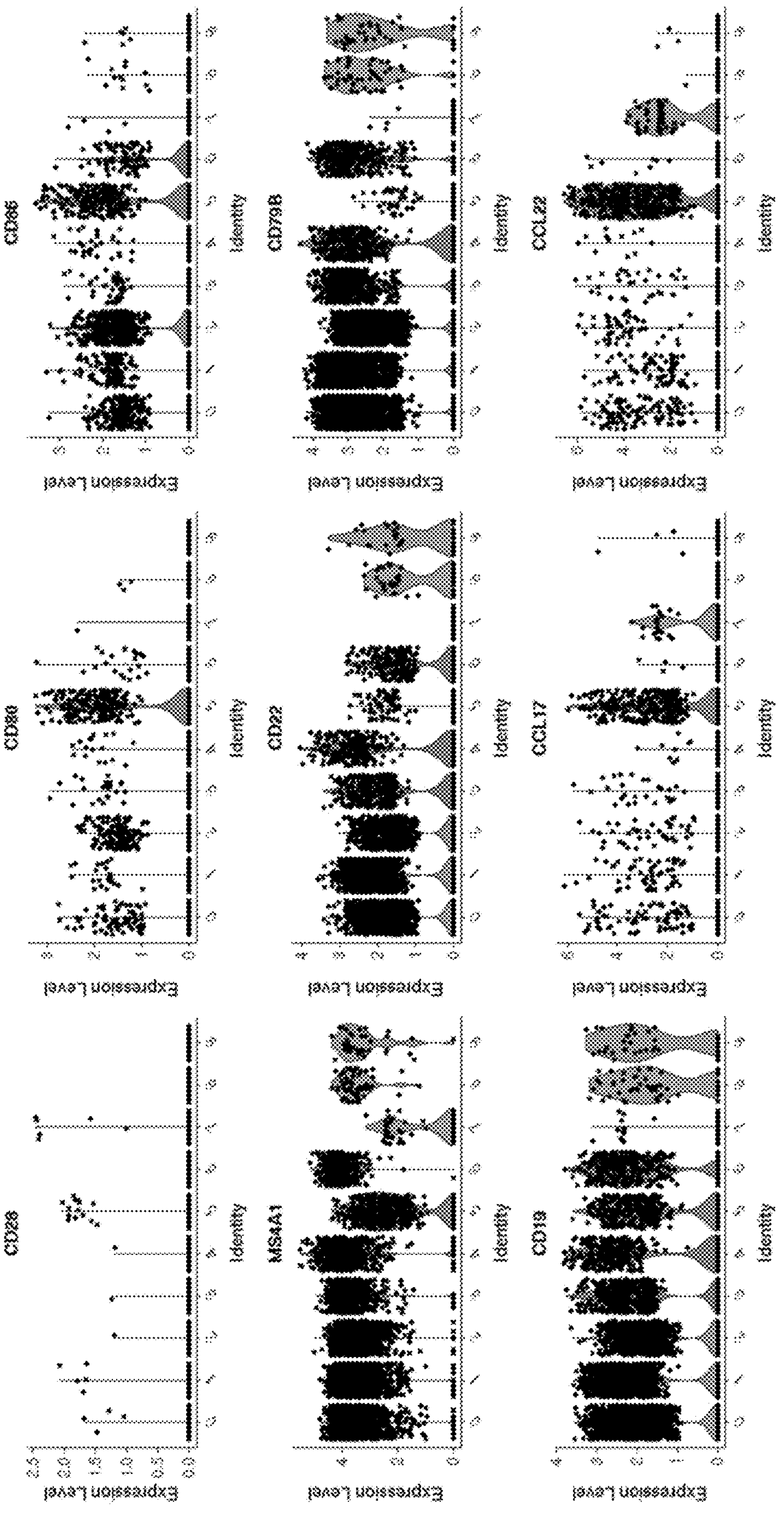
FIG. 101 show expression of surface markers of the B cells.
Figure 102:
FIG. 102 show PAP CART cells clustering 24 and 48 hours after CD19 CAR T cells and PAP CAR T cells were co-cultured with B cells.

Further, CD19 CAR T cells and PAP CAR T cells were co-cultured with B cells for 24 or 48 hrs (hours), and scRNA profiling assay was performed on T cells including both CD19 CAR T cells and PAP CART cells as well as B cells. FIG. 100 shows B cell clustering 24 hours after CD19 CART cells and PAP CART cells were co-cultured with these B cells. Two clusters of B cells were found in the 24 hrs samples: BC5 and BC7 clusters. Further analysis was performed to identify phenotypes of the B cells. FIG. 101 shows the expression of surface markers of the B cells. It appears that the cells of BC5 and BC7 were in an activated state: BC5 differentiating towards BC7, and BC7 differentiating towards plasma cell, but not fully differentiated into plasma cells. FIG. 102 show PAP CART cells clustering 24 and 48 hrs after CD19 CART cells and PAP CART cells were co-cultured with B cells. It appears that, as compared to 0 h, 24 hrs and 48 hrs showed enrichment of multiple CAR T cells, including TC0 and TC1. The expansion cluster in CD19 CAR T cells is TC0; the expansion clusters in PAP CART cells are TC0 and TC1; and the expansion clusters in NT cells are TC2, TC4, and TC10. TC10 appeared to be similar to TC0. It is speculated that TC0 was differentiated from TC10. Both groups of cells are CD4/CD8 double negative. The proliferation of CD19 CAR T cell groups has low interaction with B cells; PAP CAR T cells of TC1 and NT cells of TC2 appear to interact with B cells. FIG. 103 shows highly expressed genes in PAP CAR T cells in TC1. For example, CCR4 is highly expressed in TC1, and CCL17 and CCL22 bound to CCR4 were found to be highly expressed in B cells of C5. The interaction of the B cells and CAR T cells activates the JAK-STAT pathway, thereby inducing expansion of PAP CAR T cells, which is consistent with B cell ligand expression (CCL17 and CCL22) as shown in FIG. 101.

Figure 104:
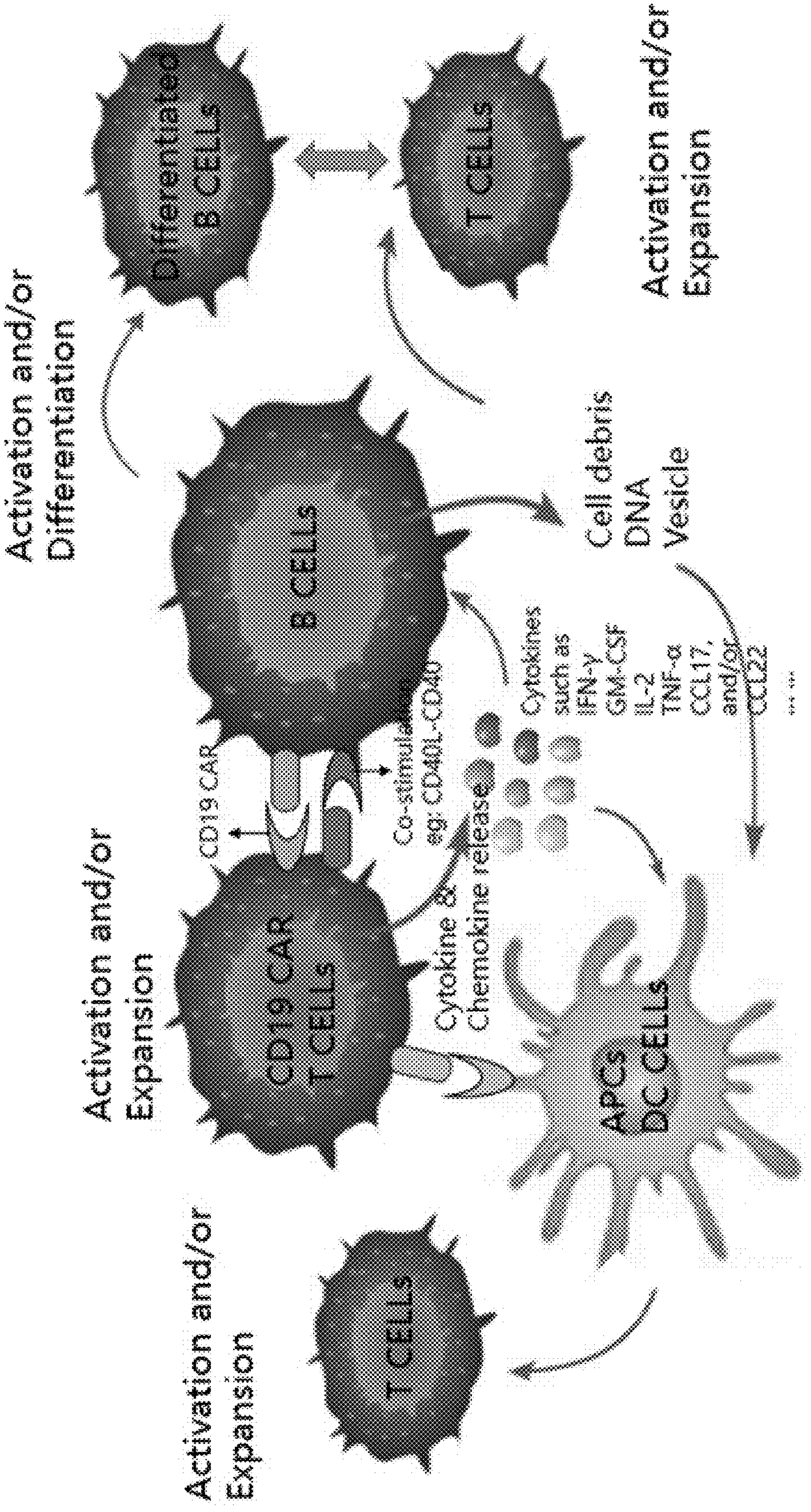
FIGS. 104, 105, and 106 show embodiments of Coupled-CAR® illustrated in FIG.
Figure 105:
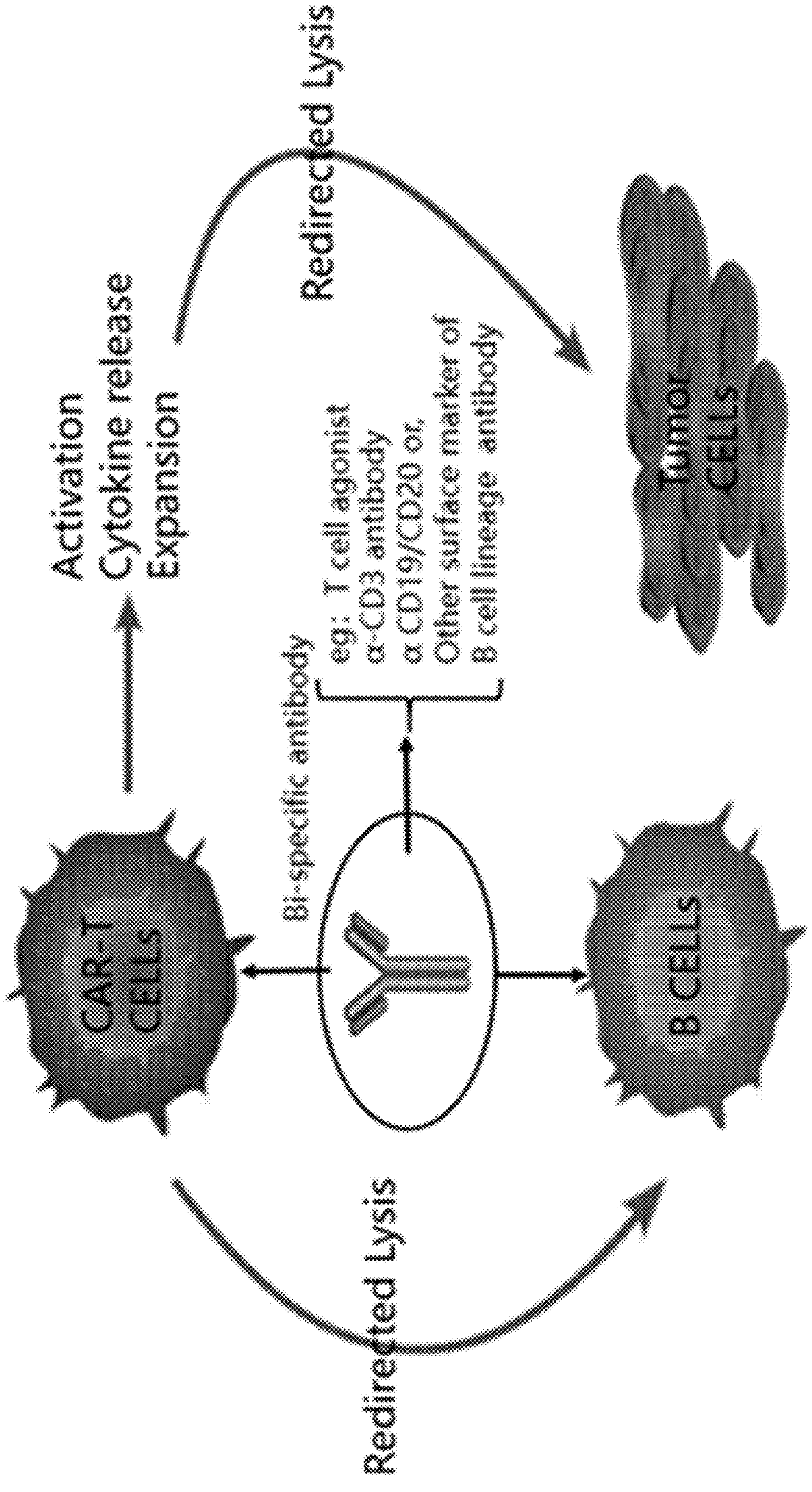
Figure 106:
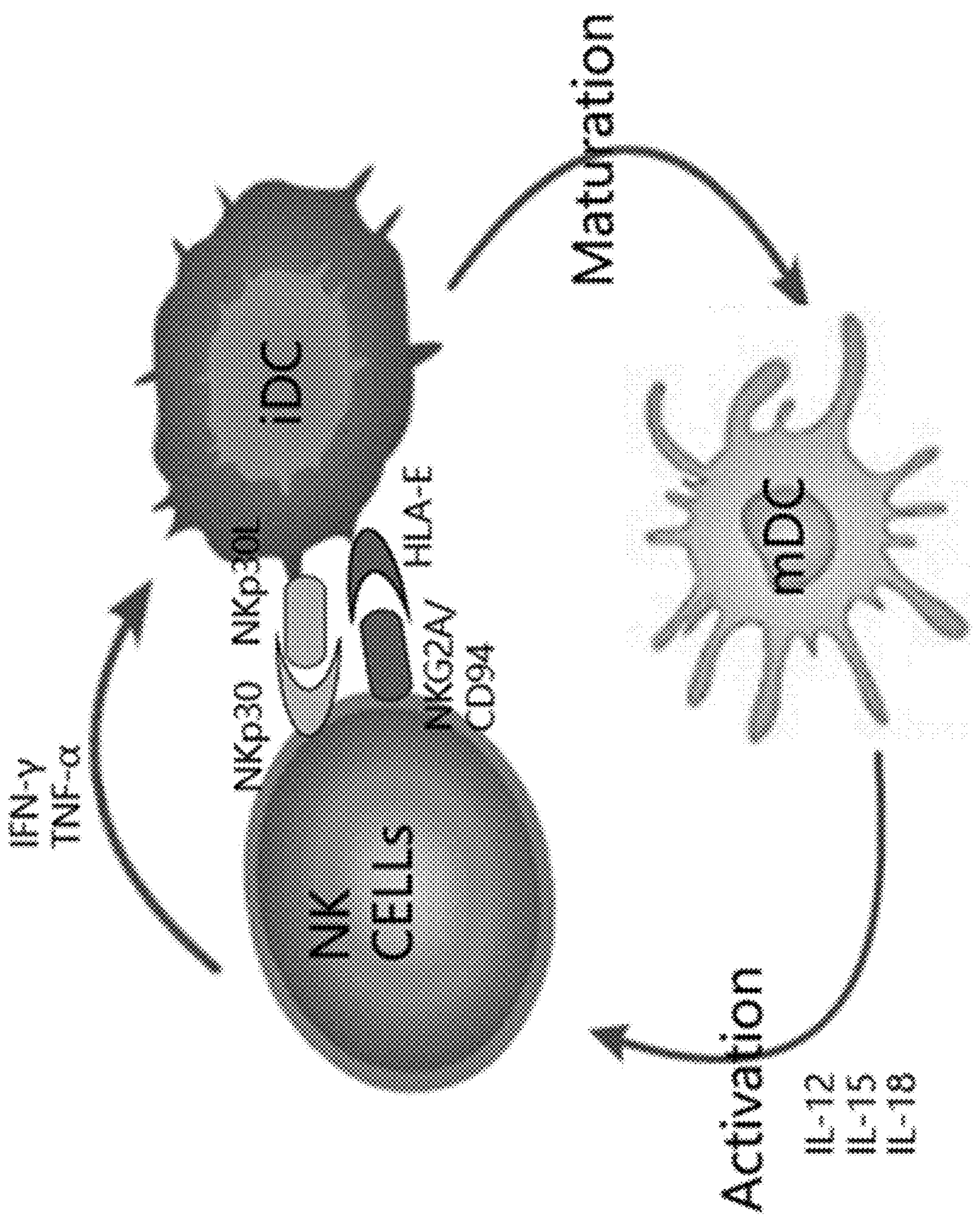

In sum, these results indicate several mechanisms involved in a CoupledCAR® system, which are shown in FIGS. 104-106. As shown in FIG. 104, B cells can be activated and become differentiated B cells of which the expression of surface markers is shown in FIG. 101. The activation and differentiation of B cells can be implemented by various methods, for example, by using CD19 CART cells, CD19 antibody, bispecific antibody (e.g., CD3-CD19/BCMA), cytokines (e.g., IL4). T cells including solid tumor CART cells can also be activated to release cytokines to activate other APCs and DCs, and some B cells can be lysed thereby releasing cell debris. These released cytokines and debris can activate APCs including B cells and DCs. These APCs can upregulate co-stimulation molecules or ligands such as CD40, which can interact with T cells to cause or induce the expansion of T cells without binding corresponding antigens. Also, interaction between differentiated B cells and T cells can cause or induce activation or expansion of T cells, which is supported by FIGS. 100-103. Bispecific antibody can replace the role of T cells targeting B cells and cause T cells to expand without binding corresponding antigens as shown in FIG. 105. FIG. 106 shows application of CoupledCAR® technology to expand NK cells.

All publications, patents and patent applications cited in this specification are incorporated herein by reference in their entireties as if each individual publication, patent or patent application were specifically and individually indicated to be incorporated by reference. While the foregoing has been described in terms of various embodiments, the skilled artisan will appreciate that various modifications, substitutions, omissions, and changes may be made without departing from the spirit thereof.

SEQUENCE LISTING (365 sequences)

SEQ ID NO: 1 - protein, 21 aa, Homo sapiens
MALPVTALLLPLALLLHAARP

SEQ ID NO: 2 - protein, 69 aa, Artificial Sequence
  Synthesized
AKPTTTPAPRPPTPAPTIASQPLSLRPEACRPAAGGAVHTRGLDFACDIYIWAPLAGTCGVLLLSLVIT

SEQ ID NO: 3 - protein, 42 aa, Artificial Sequence
  Synthesized
KRGRKKLLYIFKQPFMRPVQTTQEEDGCSCRFPEEEEGGCEL

SEQ ID NO: 4 - protein, 112 aa, Artificial Sequence
  Synthesized
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5 - protein, 242 aa, Artificial Sequence
  Synthesized
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSS

SEQ ID NO: 6 - protein, 242 aa, Artificial Sequence
  Synthesized
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 7 - protein, 237 aa, Artificial Sequence
  Synthesized
DIQMTQSPASLSVSVGETVTITCRASENIYSNLAWYQQKQGKSPQLLVYVATNLADGVPSRFSGSGSGTQYSLKINSLQSEDFGSYYCQHFWGTPYTFGGGTKLGGGGSGGGGSGGGGSEVQLQQSGAELVKPGASVKLSCTASGFNINDTYMHWVKQRPEQGLEWIGRIDPANGNTKYDPKFQGKATITADTSSNTAYLQLSSLTSEDTAVYYCARGARGSRFAYWGQGTLVTVSA

SEQ ID NO: 8 - protein, 244 aa, Artificial Sequence
  Synthesized
QSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSS

SEQ ID NO: 9 - protein, 252 aa, Artificial Sequence
  Synthesized
DIVLTQSPASLAVSLGQGATISCRASKSVSTSGYTYMHWYQQKPGQPPKLLIYLASNLESGVPARFSGSGSGTDFTLNIHPVEEEDAATYYCQHSGELPPSFGGGTKLEIKRAGGGGSGGGGSGGGGSEVQLVESGGDLVKPGGSLKLSCAVSGFTFSSYGMSWVRQTPDKRLEWVATVSSGGTYTYYPDSVKGRFTISRDNAKNTLYLQMSSLKSEDSAMYYCARHRGNYYATYYYAMDYWGQGTSVTVSS

SEQ ID NO: 10 - protein, 243 aa, Artificial Sequence
  Synthesized
DVQITQSPSYLAASPGETITINCRASKSISKYLAWYQEKPGKTNKLLIYSGSTLQSGIPSRFSGSGSGTDFTLTISSLEPEDFAMYYCQQHHEYPYTFGGGTKLEIKGGGGSGGGGSGGGGSQVQLQQPGAELVRPGASVKLSCKASGYTFTTYWMNWVKQRPEQGLEWIGRIDPYDSETHYNQKFKDKAILTVDKSSSTAYMQLSSLTSEDSAVYYCARGPYYGTNPWFPYWGQGTLVTVSS

SEQ ID NO: 11 - protein, 241 aa, Artificial Sequence
  Synthesized
EIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSS

SEQ ID NO: 12 - protein, 246 aa, Artificial Sequence
  Synthesized
DVVMTQTPLSLPVRLGDQASISCRSSQSLVHSNGNTYLHWYLQKPGQSPKLLIYKVSNRFSGVPDRFSGSGSGTNFTLKISRVEAEDLGLYFCSQSTHVPYTFGGGTKLEIKRAGGGGSGGGGSGGGGSQVQLRQSGPELVKPGASVKMSCKASGYTFTDYVISWVKQRTGQGLEWIGDIYPGSGYSFYNENFKGKATLTADKSSTTAYMQLSSLTSEDSAVYFCATYYNYPFAYWGQGTLVTVSA

SEQ ID NO: 13 - protein, 199 aa, Artificial Sequence
  Synthesized
LPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 14 - protein, 240 aa, Artificial Sequence
  Synthesized
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIKGGGGGSGGGGSGGGGSDIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 15 - protein, 281 aa, Artificial Sequence
  Synthesized
MNVPTQLLGLLLLWLTGGKCDIQMTQSPASLSASLEEIVTITCKASQAIDAYLSWYQQKPGKSPQLLIYDATSLADGVPSRFSGSRSGTQYSLKISRPQVDDSGIYYCLQSYSTPFTFGSGTKLEIKGGGGGSGGGGSGGGGSMAVLVLLLCLLIFPSCVLSQVQLKESGPGLVQPSQTLSLTCTVSGSSLTSNSVSWIRQPPGKGLEWMGVIWSNGDADYNSAIKSRLSISRDTSKSQVFLKMNSLQTEDTAMYFCASPYYGYYFPFDYWGQGVMVTVSS

SEQ ID NO: 16 - protein, 285 aa, Artificial Sequence
  Synthesized
METDTLLLWVLLLWVPGSTGDIVLTQSPALAVSLGQRATISCRASQSVSISSHDLMQWYQQKPGQQPKLLIYDAFNLASGIPVRFSGSGSGTDFTLTIDPVQADDIATYYCQQSKDDPYTFGAGTKLELKGGGGGSGGGGSGGGGSMDIRLSLAFLVLFIKGVQCEVQLVESGGGLVQPGRSMKLSCAASGFTFSNYGMAWVRQAPTKGLEWVATISYDGSITYYRDSVKGRFTISRDHAKSTLYLQMNSLRSEDTATYYCTREEQYSSWYFDFWGPGIMVTVSS

SEQ ID NO: 17 - protein, 242 aa, Artificial Sequence
  Synthesized
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIKGGGGGSGGGGSGGGGSQVTLKESGPVLVKPTETLTLTCTFSGFSLSTSGMGVGWIRQAPGKGLEWVAHIWWDDDVYYNPSLKSRLTITKDASKDQVSLKLSSVTAADTAVYYCVRRRATGTGFDYWGQGTLVTVSS

SEQ ID NO: 18 - protein, 272 aa, Homo sapiens
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWK

SEQ ID NO: 19 - protein, 205 aa, Homo sapiens
ISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKR

SEQ ID NO: 20 - protein, 393 aa, Homo sapiens
GMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 21 - protein, 210 aa, Homo sapiens
QLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMND

SEQ ID NO: 22 - protein, 4368 aa, Homo sapiens
EQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYG

SEQ ID NO: 23 - protein, 407 aa, Homo sapiens
SQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQ

SEQ ID NO: 24 - protein, 264 aa, Homo sapiens
PRFMGTISDVKTNVQLLKGRVDNISTLDSEIKKNSDGMEAAGVQIQMVNESLGYVRSQFLKLKTSVEKANAQIQILTRSWEEVSTLNAQIPELKSDLEKASALNTKIRALQGSLENMSKLLKRQNDILQVVSQGWKYFKGNFYYFSLIPKTWYSAEQFCVSRNSHLTSVTSESEQEFLYKTAGGLIYWIGLTKAGMEGDWSWVDDTPFNKVQSVRFWIPGEPNNAGNNEHCGNIKAPSLQAWNDAPCDKTFLFICKRPYVPSEP

SEQ ID NO: 25 - protein, 100 aa, Homo sapiens
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENC

SEQ ID NO: 26 - protein, 371 aa, Homo sapiens
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 27 - protein, 348 aa, Homo sapiens
RLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNP

SEQ ID NO: 28 - DNA, 7902 bp, Artificial Sequence
  Synthesized
gtcgacactagtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgccgcggaattcgagctcggtacctttaagaccaatgacttacaaggcagctgtagatcttagccactttttaaaagaaaaggggggactggaagggctaattcactcccaacgaagacaagatctgctttttgcttgtactgagtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacggctctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatcacgagactagcctcgacacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagaaatccactttggctcgagaagcttgatatcggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcc

SEQ ID NO: 29 - protein, 66 aa, Artificial Sequence
  Synthesized
TTTPAPRPPTPAPTIASQPLSLRPEACRPAAGGAVHTRGLDFACDIYIWAPLAGTCGVLLLSLVIT

SEQ ID NO: 30 - protein, 69 aa, Artificial Sequence
  Synthesized
TTTPAPRPPTPAPTIASQPLSLRPEACRPAAGGAVHTRGLDFACDIYIWAPLAGTCGVLLLSLVITLYC

SEQ ID NO: 31 - protein, 72 aa, Artificial Sequence
  Synthesized
AKPTTTPAPRPPTPAPTIASQPLSLRPEACRPAAGGAVHTRGLDFACDIYIWAPLAGTCGVLLLSLVITLYC

SEQ ID NO: 32 - protein, 50 aa, Artificial Sequence
  Synthesized
AKPTTTPAPRPPTPAPTIASQPLSLRPEACRPAAGGAVHTRGLDFACDIY

SEQ ID NO: 33 - protein, 47 aa, Artificial Sequence
  Synthesized
TTTPAPRPPTPAPTIASQPLSLRPEACRPAAGGAVHTRGLDFACDIY

SEQ ID NO: 34 - protein, 22 aa, Artificial Sequence
  Synthesized
IWAPLAGTCGVLLLSLVITLYC

SEQ ID NO: 35 - protein, 120 aa, Artificial Sequence
  Synthesized
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNR

SEQ ID NO: 36 - protein, 19 aa, Artificial Sequence
  Synthesized
IWAPLAGTCGVLLLSLVIT

SEQ ID NO: 37 - DNA, 339 bp, Artificial Sequence
  Synthesized
agagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 38 - DNA, 1689 bp, Artificial Sequence
  Synthesized
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 39 - DNA, 1689 bp, Homo sapiens
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 40 - DNA, 1689 bp, Artificial Sequence; identical to SEQ ID NO: 38
  Synthesized

SEQ ID NO: 41 - DNA, 1689 bp, Artificial Sequence; identical to SEQ ID NO: 39
  Synthesized

SEQ ID NO: 42 - protein, 106 aa, Artificial Sequence
  Synthesized
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIK

SEQ ID NO: 43 - protein, 120 aa, Artificial Sequence
  Synthesized
QVTLKESGPVLVKPTETLTLTCTFSGFSLSTSGMGVGWIRQAPGKGLEWVAHIWWDDDVYYNPSLKSRLTITKDASKDQVSLKLSSVTAADTAVYYCVRRRATGTGFDYWGQGTLVTVSS

SEQ ID NO: 44 - protein, 130 aa, Artificial Sequence
  Synthesized
METDTLLLWVLLLWVPGSTGDIVLTQSPALAVSLGQRATISCRASQSVSISSHDLMQWYQQKPGQQPKLLIYDAFNLASGIPVRFSGSGSGTDFTLTIDPVQADDIATYYCQQSKDDPYTFGAGTKLELK

SEQ ID NO: 45 - protein, 139 aa, Artificial Sequence
  Synthesized
MDIRLSLAFLVLFIKGVQCEVQLVESGGGLVQPGRSMKLSCAASGFTFSNYGMAWVRQAPTKGLEWVATISYDGSITYYRDSVKGRFTISRDHAKSTLYLQMNSLRSEDTATYYCTREEQYSSWYFDFWGPGIMVTVSS

SEQ ID NO: 46 - protein, 112 aa, Artificial Sequence
  Synthesized
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 47 - protein, 119 aa, Artificial Sequence
  Synthesized
EVQLVQSGAEVKKPGASVKVSCKASGYTFTNYYIHWVRQAPGQGLEWIGWIYPGDGNTKYNEKFKGRATLTADTSTSTAYLELSSLRSEDTAVYYCARDSYSNYYFDYWGQGTLVTVSS

SEQ ID NO: 48 - protein, 413 aa, Artificial Sequence
  Synthesized
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 49 - protein, 115 aa, Artificial Sequence
  Synthesized
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSS

SEQ ID NO: 50 - protein, 108 aa, Artificial Sequence
  Synthesized
EIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIK

SEQ ID NO: 51 - protein, 140 aa, Artificial Sequence
  Synthesized
MGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAA

SEQ ID NO: 52 - protein, 131 aa, Artificial Sequence
  Synthesized
MGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIR

SEQ ID NO: 53 - protein, 120 aa, Artificial Sequence
  Synthesized
QVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSS

SEQ ID NO: 54 - protein, 111 aa, Artificial Sequence
  Synthesized
EIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 55 - DNA, 1473 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 56 - DNA, 1446 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 57 - DNA, 1467 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 58 - DNA, 3533 bp, Artificial Sequence
  Synthesized
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 59 - DNA, 3533 bp, Artificial Sequence
  Synthesized
atggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 60 - DNA, 3545 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 61 - DNA, 3518 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 62 - DNA, 2994 bp, Artificial Sequence
  Synthesized
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 63 - DNA, 2994 bp, Artificial Sequence
  Synthesized
atggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 64 - DNA, 3009 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 65 - DNA, 2982 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 66 - protein, 244 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 67 - protein, 116 aa, Artificial Sequence
  Synthesized
QVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 68 - protein, 113 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 69 - protein, 12 aa, Artificial Sequence
  Synthesized
QSLLNSGDQKNY

SEQ ID NO: 70 - protein, 107 aa, Artificial Sequence
  Synthesized
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIK

SEQ ID NO: 71 - protein, 9 aa, Artificial Sequence
  Synthesized
QNDYSYPLT

SEQ ID NO: 72 - protein, 8 aa, Artificial Sequence
  Synthesized
GYTFTDHA

SEQ ID NO: 73 - protein, 8 aa, Artificial Sequence
  Synthesized
FSPGNTDI

SEQ ID NO: 74 - protein, 9 aa, Artificial Sequence
  Synthesized
KTSTFFFDY

SEQ ID NO: 75 - protein, 246 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 76 - protein, 117 aa, Artificial Sequence
  Synthesized
EVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 77 - protein, 114 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRA

SEQ ID NO: 78 - protein, 16 aa, Artificial Sequence
  Synthesized
RSSKSLLHSNGITYFF

SEQ ID NO: 79 - protein, 7 aa, Artificial Sequence
  Synthesized
QMSNLAS

SEQ ID NO: 80 - protein, 9 aa, Artificial Sequence
  Synthesized
AQNLELPPT

SEQ ID NO: 81 - protein, 5 aa, Artificial Sequence
  Synthesized
NYWMN

SEQ ID NO: 82 - protein, 19 aa, Artificial Sequence
  Synthesized
EIRLKSNNYTTHYAESVKG

SEQ ID NO: 83 - protein, 6 aa, Artificial Sequence
  Synthesized
HYYFDY

SEQ ID NO: 84 - protein, 4 aa, Artificial Sequence
  Synthesized
GSTA

SEQ ID NO: 85 - protein, 97 aa, Artificial Sequence
  Synthesized
CSRAARGTIGARRTGQPLKEDPSAVPVFSVDAGELDFQWREKTPEPPVPCVPEQTEAATIVFPSGMGTSSPARRGSADGPRSAQPLRPEDGHCSWPL

SEQ ID NO: 86 - protein, 17 aa, Artificial Sequence
  Synthesized
CSRAARGTIDGHCSWPL

SEQ ID NO: 87 - protein, 21 aa, Artificial Sequence
  Synthesized
VGVVGGLLGSLVLLVWVLAVI

SEQ ID NO: 88 - protein, 18 aa, Artificial Sequence
  Synthesized
GNILNVSIKICLTLSPST

SEQ ID NO: 89 - protein, 9 aa, Artificial Sequence
  Synthesized
CSRAARGTI

SEQ ID NO: 90 - protein, 80 aa, Artificial Sequence
  Synthesized
GARRTGQPLKEDPSAVPVFSVDYGELDFQWREKTPEPPVPCVPEQTEYATIVFPSGMGTSSPARRGSADGPRSAQPLRPE

SEQ ID NO: 91 - protein, 196 aa, Flavobacterium ameridies
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 92 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVKENQTRNKHINPNEWWKVYPSSVTEFKFLFVSGHFKGNYKAQLTRLNHKTNCNGAVLSVEELLIGGEMIKAGTLTLEEVRRKFNNGEINF

SEQ ID NO: 93 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMERYVEENQTRNKHLNPNEWWKVYPSSVTEFKFLFVSGHFKGNYKAQLTRLNHITNCNGAVLSVEELLIGGEMIKAGTLTLEEVRRKFNNGEINF

SEQ ID NO: 94 - protein, 323 aa, Artificial Sequence [sequence omitted]

SEQ ID NO: 95 - protein, 127 aa, Artificial Sequence
  Synthesized
MNVPTQLLGLLLLWLTGGKCDIQMTQSPASLSASLEEIVTITCKASQAIDAYLSWYQQKPGKSPQLLIYDATSLADGVPSRFSGSRSGTQYSLKISRPQVDDSGIYYCLQSYSTPFTFGSGTKLEIK

SEQ ID NO: 96 - protein, 184 aa, Homo sapiens
MAPLLPIRTLPLILILLALLSPGAADFNISSLSGLLSPALTESLLVALPPCHLTGGNATLMVRRANDSKVVTSSFVVPPCRGRRELVSVVDSGAGFTVTRLSAYQVTNLVPGTKFYISYLVKKGTATESSREIPMSTLPRRNMESIGLGMARTGGMVVITVLLSVAMFLLVLGFIIALALGSRK

SEQ ID NO: 97 - protein, 909 aa, Homo sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 98 - protein, 553 aa, Homo sapiens
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 99 - protein, 418 aa, Homo sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQVLKVIFAVAFCLISAVLMVLLFIHIRRGLCWQRESYGNI

SEQ ID NO: 100 - protein, 560 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMS

SEQ ID NO: 101 - protein, 14507 aa, Homo sapiens
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTYTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGSSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLRTLNTLDINLESGTTSSPSWKSSPYERIAPSESTTDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVSWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAVANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLNPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILAITEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRIHIPDSDQSTMSPDIITEVITRLSSSSMMSESTQMTITTQKSSPGATAQSTLTLATTTAPLARTHSTVPPRFLHSEMTTLMSRSPENPSWKSSLFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGVITCLICGVLVTTRRRKKEGEYNVQQQCPGYYQSHLDLEDLQ

SEQ ID NO: 102 - protein, 267 aa, Homo sapiens
MMSSKPTSHAEVNETIPNPYPPSSFMAPGFQQPLGSINLENQAQGAQRAQPYGITSPGIFASSQPGQGNIQMINPSVGTAVMNFKEEAKALGVIQIMVGLMHIGFGIVLCLISFSFREVLGFASTAVIGGYPFWGGLSFIISGSLSVSASKELSRCLVKGSLGMNIVSSILAFIGVILLLVDMCINGVAGQDYWAVLSGKGISATLMIFSLLEFFVACATAHFANQANTTTNMSVLVIPNMYESNPVTPASSSAPPRCNNYSANAPK

SEQ ID NO: 103 - protein, 535 aa, Homo sapiens
MLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 104 - protein, 520 aa, Homo sapiens
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 105 - protein, 221 aa, Homo sapiens
MLTLEDKDMKGFSWAIVPALTSLGYLIILVVSIFPFWVRLTNEESHEVFFSGLFENCFNAKCWKPRPLSIYIILGRVFLLSAVFLAFVTTFIMMPFASEFFPRTWKQNFVLACISFFTGACAFLALVLHALEIKALRMKLGPLQFSVLWPYYVLGFGIFLFIVAGTICLIQEMVCPCWHLLSTSQSMEEDHGSLYLDNLESLGGEPSSVQKETQVTAETVI

SEQ ID NO: 106 - protein, 538 aa, Homo sapiens
MGLLLLVLILTPSLAAYRHPDFPLLEKAQQLLQSTGSPYSTNCWLCTSSSTETPGTAYPASPREWTSIEAELHISYRWDPNLKGLMRPANSLLSTVKQDFPDIRQKPPIFGPIFTNINLMGIAPICVMAKRKNGTNVGTLPSTVCNVTFTVDSNQQTYQTYTHNQFRHQPRFPKPPNITFPQGTLLDKSSRFCQGRPSSCSTRNFWFRPADYNQCLQISNLSSTAEWVLLDQTRNSLFWENKTKGANQSQTPCVQVLAGMTIATSYLGISAVSEFFGTSLTPLFHFHISTCLKTQGAFYICGQSIHQCLPSNWTGTCTIGYVTPDIFIAPGNLSLPIPIYGNSPLPRVRRAIHFIPLLAGLGILAGTGTGIAGITKASLTYSQLSKEIANNIDTMAKALTTMQEQIDSLAAVVLQNRRGLDMLTAAQGGICLALDEKCCFWVNQSGKVQDNIRQLLNQASSLRERATQGWLNWEGTWKWFSWVLPLTGPLVSLLLLLLFGPCLLNLITQFVSSRLQAIKLQTNLSAGRHPRNIQESPF

SEQ ID NO: 107 - protein, 1017 aa, Homo sapiens
MVFSVRQCGHVGRTEEVLLTFKIFLVIICLHVVLVTSLEEDTDNSSLSPPPAKLSVVSFAPSSNGTPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 108 - protein, 775 aa, Homo sapiens
MEPPYSLTAHYDEFQEVKYVSRCGAGGARGASLPPGFPLGAARSATGARSGLPRWNRREVCLLSGLVFAAGLCAILAAMLALKYLGPVAAGGGACPEGCPERKAFARAARFLAANLDASIDPCQDFYSFACGGWLRRHAIPDDKLTYGTIAAIGEQNEERLRRLLARPGGGPGGAAQRKVRAFFRSCLDMREIERLGPRPMLEVIEDCGGWDLGGAEERPGVAARWDLNRLLYKAQGVYSAAALFSLTVSLDDRNSSRYVIRIDQDGLTLPERTLYLAQDEDSEKILAAYRVFMERVLSLLGADAVEQKAQEILQVEQQLANITVSEHDDLRRDVSSMYNKVTLGQLQKITPHLRWKWLLDQIFQEDFSEEEEVVLLATDYMQQVSQLIRSTPHRVLHNYLVWRVVVVLSEHLSPPFREALHELAQEMEGSDKPQELARVCLGQANRHFGMALGALFVHEHFSAASKAKVQQLVEDIKYILGQRLEELDWMDAETRAAARAKLQYMMVMVGYPDFLLKPDAVDKEYEFEVHEKTYFKNILNSIRFSIQLSVKKIRQEVDKSTWLLPPQALNAYYLPNKNQMVFPAGILQPTLYDPDFPQSLNYGGIGTIIGHELTHGYDDWGGQYDRSGNLLHWWTEASYSRFLRKAECIVRLYDNFTVYNQRVNGKHTLGENIADMGGLKLAYHAYQKWVREHGPEHPLPRLKYTHDQLFFIAFAQNWCIKRRSQSIYLQVLTDKHAPEHYRVLGSVSQFEEFGRAFHCPKDSPMNPAHKCSVW

SEQ ID NO: 109 - protein, 529 aa, Homo sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 110 - protein, 537 aa, Homo sapiens
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 111 - protein, 426 aa, Homo sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 112 - protein, 328 aa, Homo sapiens
MEKSIWLLACLAWVLPTGSFVRTKIDTTENLLNTEVHSSPAQRWSMQVPPEVSAEAGDAAVLPCTFTHPHRHYDGPLTAIWRAGEPYAGPQVFRCAAARGSELCQTALSLHGRFRLLGNPRRNDLSLRVERLALADDRRYFCRVEFAGDVHDRYESRHGVRLHVTAAPRIVNISVLPSPAHAFRALCTAEGEPPPALAWSGPALGNSLAAVRSPREGHGHLVTAELPALTHDGRYTCTAANSLGRSEASVYLFRFHGASGASTVALLLGALGFKALLLLGVLAARAARRRPEHLDTPDTPPRSQAQESNYENLSQMNPRSPPATMCSP

SEQ ID NO: 113 - protein, 620 aa, Homo sapiens
MSKSKCSVGLMSSVVAPAKEPNAVGPKEVELILVKEQNGVQLTSSTLTNPRQSPVEAQDRETWGKKIDFLLSVIGFAVDLANVWRFPYLCYKNGGGAFLVPYLLFMVIAGMPLFYMELALGQFNREGAAGVWKICPILKGVGFTVILISLYVGFFYNVIIAWALHYLFSSFTTELPWIHCNNSWNSPNCSDAHPGDSSGDSSGLNDTFGTTPAAEYFERGVLHLHQSHGIDDLGPPRWQLTACLVLVIVLLYFSLWKGVKTSGKVVWITATMPYVVLTALLLRGVTLPGAIDGIRAYLSVDFYRLCEASVWIDAATQVCFSLGVGFGVLIAFSSYNKFTNNCYRDAIVTTSINSLTSFSSGFVVFSFLGYMAQKHSVPIGDVAKDGPGLIFIIYPEAIATLPLSSAWAVVFFIMLLTLGIDSAMGGMESVITGLIDEFQLLHRHRELFTLFIVLATFLLSLFCVTNGGIYVFTLLDHFAAGTSILFGVLIEAIGVAWFYGVGQFSDDIQQMTGQRPSLYWRLCWKLVSPCFLLFVVVVSIVTFRPPHYGAYIFPDWANALGWVIATSSMAMVPIYAAYKFCSLPGSFREKLAYAIAPEKDRELVDRGEVRQFTLRHWLKV

SEQ ID NO: 114 - protein, 398 aa, Homo sapiens
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELLRLGSHPAPARAQKPGSSGLAARGLCVLGEDNAPL

SEQ ID NO: 115 - protein, 431 aa, Homo sapiens
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEIKYDFLYEKEHICCLEEWTSPVHQKIYTTFILVILFLLPLMVMLILYSKIGYELWIKKRVGDGSVLRTIHGKEMSKIARKKKRAVIMMVTVVALFAVCWAPFHVVHMMIEYSNFEKEYDDVTIKMIFAIVQIIGFSNSICNPIVYAFMNENFKKNVLSAVCYCIVNKTFSPAQRHGNSGITMMRKKAKFSLRENPVEETKGEAFSDGNIEVKLCEQTEEKKKLKRHLALFRSELAENSPLDSGH

SEQ ID NO: 116 - protein, 335 aa, Homo sapiens
MESSFSFGVILAVLASLIIATNTLVAVAVLLLIHKNDGVSLCFTLNLAVADTLIGVAISGLLTDQLSSPSRPTQKTLCSLRMAFVTSSAAASVLTVMLITFDRYLAIKQPFRYLKIMSGFVAGACIAGLWLVSYLIGFLPLGIPMFQQTAYKGQCSFFAVFHPHFVLTLSCVGFFPAMLLFVFFYCDMLKIASMHSQQIRKMEHAGAMAGGYRSPRTPSDFKALRTVSVLIGSFALSWTPFLITGIVQVACQECHLYLVLERYLWLLGVGNSLLNPLIYAYWQKEVRLQLYHMALGVKKVLTSFLLFLSARNCGPERPRESSCHIVTISSSEFDG

SEQ ID NO: 117 - protein, 220 aa, Homo sapiens
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 118 - protein, 15 aa, Homo sapiens
GGGGSGGGGSGGGGS

SEQ ID NO: 119 - protein, 45 aa, Artificial Sequence
  Synthesized
TTTPAPRPPTPAPTIASQPLSLRPEACRPAAGGAVHTRGLDFACD

SEQ ID NO: 120 - protein, 23 aa, Artificial Sequence
  Synthesized
YIWAPLAGTCGVLLLSLVITLYC

SEQ ID NO: 121 - protein, 485 aa, Artificial Sequence
  Synthesized
MALPVTALLLPLALLLHAARPQIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIKGGGGSGGGGSGGGGSEVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 122 - protein, 241 aa, Artificial Sequence
  Synthesized
QIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIKGGGGSGGGGSGGGGSEVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSA

SEQ ID NO: 123 - protein, 108 aa, Artificial Sequence
  Synthesized
QIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIK

SEQ ID NO: 124 - protein, 118 aa, Artificial Sequence
  Synthesized
EVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSA

SEQ ID NO: 125 - protein, 488 aa, Artificial Sequence
  Synthesized
MALPVTALLLPLALLLHAARPENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 126 - protein, 244 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSS

SEQ ID NO: 127 - protein, 106 aa, Artificial Sequence
  Synthesized
NVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKE

SEQ ID NO: 128 - protein, 123 aa, Artificial Sequence
  Synthesized
EVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSS

SEQ ID NO: 129 - protein, 485 aa, Artificial Sequence
  Synthesized
MALPVTALLLPLALLLHAARPDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVSTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 130 - protein, 241 aa, Artificial Sequence
  Synthesized
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVST

SEQ ID NO: 131 - protein, 107 aa, Artificial Sequence
  Synthesized
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIK

SEQ ID NO: 132 - protein, 119 aa, Artificial Sequence
  Synthesized
EVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVST

SEQ ID NO: 133 - protein, 488 aa, Artificial Sequence
  Synthesized
MALPVTALLLPLALLLHAARPENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 134 - protein, 244 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSS

SEQ ID NO: 135 - protein, 106 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELK

SEQ ID NO: 136 - protein, 123 aa, Artificial Sequence
  Synthesized
EVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSS

SEQ ID NO: 137 - protein, 482 aa, Artificial Sequence
  Synthesized
MALPVTALLLPLALLLHAARPSSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLGGGGGSGGGGSGGGGSQLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 138 - protein, 238 aa, Artificial Sequence
  Synthesized
SSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLGGGGGSGGGGSGGGGSQLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTV

SEQ ID NO: 139 - protein, 109 aa, Artificial Sequence
  Synthesized
SSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLG

SEQ ID NO: 140 - protein, 114 aa, Artificial Sequence
  Synthesized
QLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTV

SEQ ID NO: 141 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 142 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 143 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 144 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 145 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 146 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 147 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 148 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 149 - protein, 112 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIK

SEQ ID NO: 150 - protein, 112 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIK

SEQ ID NO: 151 - protein, 123 aa, Artificial Sequence
  Synthesized
EIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 152 - protein, 123 aa, Artificial Sequence
  Synthesized
EIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 153 - protein, 123 aa, Artificial Sequence
  Synthesized
EIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 154 - protein, 123 aa, Artificial Sequence
  Synthesized
EIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 155 - protein, 482 aa, Artificial Sequence
  Synthesized
MALPVTALLLPLALLLHAARPDIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKGGGGSGGGGSGGGGSEVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 156 - protein, 238 aa, Artificial Sequence
  Synthesized
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKGGGGSGGGGSGGGGSEVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSS

SEQ ID NO: 157 - protein, 107 aa, Artificial Sequence
  Synthesized
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIK

SEQ ID NO: 158 - protein, 116 aa, Artificial Sequence
  Synthesized
EVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSS

SEQ ID NO: 159 - protein, 482 aa, Artificial Sequence
  Synthesized
MALPVTALLLPLALLLHAARPDIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIKGGGGSGGGGSGGGGSDVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 160 - protein, 238 aa, Artificial Sequence
  Synthesized
DIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIKGGGGSGGGGSGGGGSDVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSA

SEQ ID NO: 161 - protein, 107 aa, Artificial Sequence
  Synthesized
DIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIK

SEQ ID NO: 162 - protein, 116 aa, Artificial Sequence
  Synthesized
DVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSA

SEQ ID NO: 163 - protein, 298 aa, Artificial Sequence
  Synthesized
MALPVTALLLPLALLLHAARPGTSLSPPPESSGSPQQPGLSAPHSRQIPAPQGAVLVQREKDLPNYNWNSFGLRFTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 164 - protein, 54 aa, Artificial Sequence
  Synthesized
GTSLSPPPESSGSPQQPGLSAPHSRQIPAPQGAVLVQREKDLPNYNWNSFGLRF

SEQ ID NO: 165 - DNA, 19 bp, Artificial Sequence
  Synthesized
gttgctccaggccacagca

SEQ ID NO: 166 - protein, 7 aa, Artificial Sequence
  Synthesized
QSGDLTR

SEQ ID NO: 167 - protein, 7 aa, Artificial Sequence
  Synthesized
QWGTRYR

SEQ ID NO: 168 - protein, 7 aa, Artificial Sequence
  Synthesized
ERGTLAR

SEQ ID NO: 169 - protein, 7 aa, Artificial Sequence
  Synthesized
RSDNLRE

SEQ ID NO: 170 - protein, 7 aa, Artificial Sequence
  Synthesized
TSGALTR

SEQ ID NO: 171 - DNA, 12 bp, Artificial Sequence
  Synthesized
gactttgcatgt

SEQ ID NO: 172 - protein, 7 aa, Artificial Sequence
  Synthesized
WRSSLAS

SEQ ID NO: 173 - protein, 7 aa, Artificial Sequence
  Synthesized
QSGSLTR

SEQ ID NO: 174 - protein, 7 aa, Artificial Sequence
  Synthesized
HKWVLRQ

SEQ ID NO: 175 - protein, 7 aa, Artificial Sequence
  Synthesized
DRSNLTR

SEQ ID NO: 176 - protein, 293 aa, Artificial Sequence
  Synthesized
MQRISSLIHLSLFWAGVMSAIELVPEHQTVPVSIGVPATLRCSMKGEAIGNYYINWYRKTQGNTITFIYREKDIYGPGFKDNFQGDIDIAKNLAVLKILAPSERDEGSYYCACDTMGHPRGKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLTRDC

SEQ ID NO: 177 - protein, 315 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEAQQELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 178 - protein, 292 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTLGMGGEYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 179 - protein, 313 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEWELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 180 - protein, 288 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTLVSTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 181 - protein, 314 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVGELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 182 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTVAHGGGTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 183 - protein, 313 aa, Artificial Sequence; identical to SEQ ID NO: 179
  Synthesized

SEQ ID NO: 184 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDNLSTGGYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 185 - protein, 316 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVYQGELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 186 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDILGEKPYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 187 - DNA, 339 bp, Artificial Sequence; identical to SEQ ID NO: 37
  Synthesized

SEQ ID NO: 188 - protein, 276 aa, Artificial Sequence
  Synthesized
MKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSDRGSTLGRLYFGRGTQLTVWPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 189 - protein, 313 aa, Artificial Sequence
  Synthesized
MTIRLLCYVGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSGLRDRGLYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 190 - protein, 267 aa, Artificial Sequence
  Synthesized
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVKDSNYQLIWGAGTKLIIKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 191 - protein, 138 aa, Artificial Sequence
  Synthesized
MAVLVLLLCLLIFPSCVLSQVQLKESGPGLVQPSQTLSLTCTVSGSSLTSNSVSWIRQPPGKGLEWMGVIWSNGDADYNSAIKSRLSISRDTSKSQVFLKMNSLQTEDTAMYFCASPYYGYYFPFDYWGQGVMVTVSS

SEQ ID NO: 192 - DNA, 3533 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 193 - protein, 488 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 194 - protein, 486 aa, Artificial Sequence
  Synthesized
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 195 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 196 - protein, 485 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 197 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 198 - protein, 483 aa, Artificial Sequence
  Synthesized
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 199 - DNA, 3515 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 200 - DNA, 3533 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 201 - protein, 490 aa, Artificial Sequence
  Synthesized
MALPVTALLLPLALLLHAARPDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 202 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 203 - protein, 487 aa, Artificial Sequence
  Synthesized
MALPVTALLLPLALLLHAARPDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 204 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 205 - DNA, 3515 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 206 - DNA, 3533 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 207 - protein, 486 aa, Artificial Sequence
  Synthesized
MALPVTALLLPLALLLHAARPDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 208 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 209 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 210 - protein, 483 aa, Artificial Sequence
  Synthesized
MALPVTALLLPLALLLHAARPDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 211 - DNA, 3515 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 212 - DNA, 3533 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 213 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 214 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 215 - DNA, 3515 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 216 - DNA, 3545 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 217 - protein, 490 aa, Artificial Sequence
  Synthesized
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 218 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 219 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 220 - protein, 487 aa, Artificial Sequence
  Synthesized
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 221 - DNA, 3527 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 222 - DNA, 3545 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 223 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 224 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 225 - DNA, 3527 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 226 - DNA, 3665 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 227 - protein, 530 aa, Artificial Sequence
  Synthesized
MALPVTALLLPLALLLHAARPMGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIRGGGGSGGGGSGGGGSMGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 228 - DNA, 3656 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 229 - DNA, 3656 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 230 - protein, 527 aa, Artificial Sequence
  Synthesized
MALPVTALLLPLALLLHAARPMGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIRGGGGSGGGGSGGGGSMGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAATTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 231 - DNA, 3665 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 232 - DNA, 3656 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 233 - DNA, 3656 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 234 - DNA, 3647 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 235 - DNA, 3518 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 236 - protein, 482 aa, Artificial Sequence
  Synthesized
MALPVTALLLPLALLLHAARPEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGGGGSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 237 - DNA, 3509 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 238 - DNA, 3509 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 239 - protein, 479 aa, Artificial Sequence
  Synthesized
MALPVTALLLPLALLLHAARPEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGGGGSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 240 - DNA, 3500 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 241 - DNA, 3518 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 242 - DNA, 3509 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 243 - DNA, 3509 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 244 - DNA, 3500 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 245 - DNA, 3545 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 246 - protein, 490 aa, Artificial Sequence
  Synthesized
MALPVTALLLPLALLLHAARPEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKGGGGSGGGGSGGGGSQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 247 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 248 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 249 - protein, 487 aa, Artificial Sequence
  Synthesized
MALPVTALLLPLALLLHAARPEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKGGGGSGGGGSGGGGSQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 250 - DNA, 3527 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 251 - DNA, 3545 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 252 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 253 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 254 - DNA, 3527 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 255 - protein, 505 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 256 - protein, 505 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 257 - protein, 728 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 258 - protein, 725 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 259 - protein, 728 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 260 - protein, 731 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 261 - protein, 728 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 262 - protein, 725 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 263 - protein, 728 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 264 - protein, 731 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 265 - protein, 5 aa, Artificial Sequence
  Synthesized
GGGGS

SEQ ID NO: 266 - DNA, 1470 bp, Artificial Sequence
  Synthesized
atggccttaccagtgaccgccttgctcctgccgctggccttgctgctccacgccgccaggccgcagtccgtgctgacccagccaccttccgtgtctgccgctccaggccagaaggtgacaatcagctgctccggcagctcctctgacatcggaagcaactacgtgtcctggtaccagcagttcccaggcaccgcccccaagctgctgatctacgacaacaacaagaggcctagcgccatcccagatagattttctggcagcaagtccggaacctccgccacactgggcatcaccggactgcagacaggcgacgaggctgattactactgcggcacatgggattccaggctgggaatcgccgtgttcggaggaggaacccagctgacagtgctgggcggaggaggaggaagcggaggaggaggatccggaggaggaggatctgaggtgcagctggtgcagtctggcgccgaggtgaagaagcctggacagtctctgaagatcagctgtaaggcttccggctactctctgaccgacaactggatcggatgggtgcggcagaagccaggcaagggactggagtggatgggcatcatctacccaggagactctgatacacgctactctcccagctttcagggccaggtgaccatctccgccgataagtctatcaacacagcttacctgcagtggagctccctgaaggccagcgacaccgctatctactactgcgtgggcctggattggaactacaacccactgaggtactggggacctggaaccctggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 267 - protein, 237 aa, Artificial Sequence
  Synthesized
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS

SEQ ID NO: 268 - protein, 111 aa, Artificial Sequence
  Synthesized
QSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLG

SEQ ID NO: 269 - protein, 119 aa, Artificial Sequence [sequence omitted]

SEQ ID NO: 270 - protein, 20 aa, Artificial Sequence
  Synthesized
GGGGSGGGGSGGGGSGGGGS

SEQ ID NO: 271 - protein, 120 aa, Artificial Sequence
  Synthesized
EVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSS

SEQ ID NO: 272 - protein, 240 aa, Artificial Sequence
  Synthesized
DIVMTQSHKFMSTSIGARVSITCKASQDVRTAVAWYQQKPGQSPKLLIYSASYRYTGVPDRFTGSGSGTDFTFTISSVQAEDLAVYYCQQHYGTPPWTFGGGTKLEIKGGGGSGGGGSGGGGSEVQLVESGGGLVKPGGSLKLSCEASRFTFSSYAMSWVRQTPEKRLEWVAAISGGGRYTYYPDSMKGRFTISRDNAKNFLYLQMSSLRSEDTAMYYCARHYDGYLDYWGQGTTLTVSS

SEQ ID NO: 273 - protein, 238 aa, Artificial Sequence
  Synthesized
DIVMTQSHKFMSTSIGARVSITCKASQDVRTAVAWYQQKPGQSPKWYSASYRYTGVPDRFTGSGSGTDFTFTISSVQAEDLAVYYCQQHYGTPPWTFGGGTKLEIKGGGGSGGGGSGGGGSEVQLVESGGGLVKPGGSLKLSCEASRFTFSSYAMSWVRQTPEKRLEWVAAISGGGRYTYYPDSMKGRFTISRDNAKNFLYLQMSSLRSEDTAMYYCARHYDGYLDYWGQGTTLTVSS

SEQ ID NO: 274 - protein, 244 aa, Artificial Sequence
  Synthesized
EVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSSGGGGSGGGGSGGGGSDIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIK

SEQ ID NO: 275 - protein, 113 aa, Artificial Sequence
  Synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIK

SEQ ID NO: 276 - protein, 118 aa, Artificial Sequence
  Synthesized
QVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSS

SEQ ID NO: 277 - protein, 490 aa, Artificial Sequence
  Synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 278 - protein, 510 aa, Artificial Sequence
  synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 279 - protein, 510 aa, Artificial Sequence
  synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 280 - protein, 510 aa, Artificial Sequence
  synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 281 - protein, 510 aa, Artificial Sequence
  synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 282 - protein, 510 aa, Artificial Sequence
  synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSS

SEQ ID NO: 283 - protein, 510 aa, Artificial Sequence
  synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIK

SEQ ID NO: 284 - protein, 510 aa, Artificial Sequence
  synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSS

SEQ ID NO: 285 - protein, 510 aa, Artificial Sequence
  synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELK

SEQ ID NO: 286 - protein, 754 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 287 - protein, 754 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 288 - protein, 754 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 289 - protein, 754 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 290 - protein, 754 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 291 - protein, 754 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 292 - protein, 754 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 293 - protein, 754 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 294 - protein, 753 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 295 - protein, 753 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 296 - protein, 753 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 297 - protein, 753 aa, Artificial Sequence
  synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 298 - protein, 753 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 299 - protein, 753 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 300 - protein, 753 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 301 - protein, 753 aa, Artificial Sequence
  synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSSGGGGSGGGGSGGGGSDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 302 - protein, 242 aa, Artificial Sequence
  synthesized
EVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSGGGGSGGGGSGGGGSDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIK

SEQ ID NO: 303 - protein, 245 aa, Artificial Sequence
  synthesized
QSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSS

SEQ ID NO: 304 - protein, 245 aa, Artificial Sequence
  synthesized
EVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSGGGGGSGGGGSGGGGSQSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVL

SEQ ID NO: 305 - protein, 241 aa, Artificial Sequence
  synthesized
QVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSGGGGSGGGGSGGGGSEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIK

SEQ ID NO: 306 - protein, 243 aa, Artificial Sequence
  synthesized
QSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSS

SEQ ID NO: 307 - protein, 243 aa, Artificial Sequence
  synthesized
EVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSGGGGSGGGGSGGGGSQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVL

SEQ ID NO: 308 - protein, 236 aa, Artificial Sequence
  synthesized
SIVMTQSPATLSVTPGDRVSLSCRASQSIGDYLHWFQQKSHESPRLLIKYASQSISGIPSRFSGSGSGSDFTLIINTMEPEDVGVYYCQNAHTYPYTFGGGTKLEIKGGGGSGGGGSGGGGSQVKLQQSGPELVRPGASVKMSCKASGYTFTTYWMHWVKQRPGQGLEWIGMIDPSNSDTRLNQKFKDKATLNVDTSSNTAYMHLSSLTSEDSAVYYCTLGGTEYWGQGATLTVSS

SEQ ID NO: 309 - protein, 236 aa, Artificial Sequence
  synthesized
QVKLQQSGPELVRPGASVKMSCKASGYTFTTYWMHWVKQRPGQGLEWIGMIDPSNSDTRLNQKFKDKATLNVDTSSNTAYMHLSSLTSEDSAVYYCTLGGTEYWGQGATLTVSSGGGGSGGGGSGGGGSSIVMTQSPATLSVTPGDRVSLSCRASQSIGDYLHWFQQKSHESPRLLIKYASQSISGIPSRFSGSGSGSDFTLIINTMEPEDVGVYYCQNAHTYPYTFGGGTKLEIK

SEQ ID NO: 310 - protein, 242 aa, Artificial Sequence
  synthesized
SIVMTQTPLTLSVTIGQPASISCKSSQSLLYSDGQTYLNWLLQRPGQSPKRLIYLVSKLDSGVPDRFTGSGSGTDFTLKISRVEAEDLGVYYCVQTTHFPYTFGGGTKLEMKGGGGSGGGGSGGGGSQVQLKESGGGLVQPGESLKLSCESSEFPFPSHDMSWVRKTPEKRLELVAAINSDGGSTYYPDTMERRFIISRDNTKKTLYLQMSSLRSEDTALYYCASLPTFAYWGQGTLVTVSA

SEQ ID NO: 311 - protein, 242 aa, Artificial Sequence
  synthesized
QVQLKESGGGLVQPGESLKLSCESSEFPFPSHDMSWVRKTPEKRLELVAAINSDGGSTYYPDTMERRFIISRDNTKKTLYLQMSSLRSEDTALYYCASLPTFAYWGQGTLVTVSAGGGGSGGGGSGGGGSSIVMTQTPLTLSVTIGQPASISCKSSQSLLYSDGQTYLNWLLQRPGQSPKRLIYLVSKLDSGVPDRFTGSGSGTDFTLKISRVEAEDLGVYYCVQTTHFPYTFGGGTKLEMK

SEQ ID NO: 312 - protein, 237 aa, Artificial Sequence
  synthesized
DIVMTQSHKFMSTSVGDRVSIICKASQDVGTAVDWYQQKPGQSPKLLIYWASTRHTGVPDRFTGSGSGTDFTLAITNVQSEDLADYFCQQYNSYPLTFGAGTKLEIKGGGGSGGGGSGGGGSEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTLTVSS

SEQ ID NO: 313 - protein, 237 aa, Artificial Sequence
  synthesized
EVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTLTVSSGGGGSGGGGSGGGGSDIVMTQSHKFMSTSVGDRVSIICKASQDVGTAVDWYQQKPGQSPKLLIYWASTRHTGVPDRFTGSGSGTDFTLAITNVQSEDLADYFCQQYNSYPLTFGAGTKLEIK

SEQ ID NO: 314 - protein, 245 aa, Artificial Sequence
  Synthesized
DIQMTRAPDSLSASVGDRVTITCRASQGVDIYVAWYQQKPGKAPKLLMHSASTLASGVPSRFSGRGSGTDFTLTINSLQAEDVATYYCQSHNSAVVTFGQGTRLEIKGGGGSGGGGSGGGGSEVQLLESGGGLVQPGGSLRLSCAASGFTFSRYVMVWVRQAPGKGLDWVSGISPSGGVTRYADSVKGRFTISRDNSKNTLYLQMNSLRAEDTAMYYCARIRKEMTTISYFFDYWGQGTLVTVSS

SEQ ID NO: 315 - protein, 246 aa, Artificial Sequence
  Synthesized
QIVLTQSPAIMSASLGERVTMTCTASSSVNSFYLHWYQQKPGSSPKLWIHSTSNLASGVPGRFSGSGSGTSYSLTISSMEAEDAATYYCHQYHRSPYTFGGGTKLEIKGGGGSGGGGSGGGGSQVQLQQSGAELMKPGASVKISCKATGYTFSSYWIEWVKQRPGHGLEWIGEILPGSGNTYYNERFKDKATFTADTSSNTAYMQLSSLTSEDSAVYYCARRAAAYYSNPEWFAYWGQGTLVTVSA

SEQ ID NO: 316 - DNA, 9780 bp, Artificial Sequence
  Synthesized
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgactctagaactagtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgccgcggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctggctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatcacgagactagcctcgacacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatcgacttaacttgtttattgcagcttataatggttacaaataaggcaatagcatcacaaatttcacaaataaggcatttttttcactgcattctagttttggtttgtccaaactcatcaatgtatcttatcatgtctggatctcaaatccctcggaagctgcgcctgtcttaggttggagtgatacatttttatcacttttacccgtctttggattaggcagtagctctgacggccctcctgtcttaggttagtgaaaaatgtcactctcttacccgtcattggctgtccagcttagctcgcaggggaggtggtcttcattactggctagctcttctgcctctaaacagcatctggctcctcttcctcttgccggttttagcagcggggctcagttcggccatcacttggatcagctcgtggatggcctttctctggacgttcagatcggtcacggagtagttggtgagcttctcgaagtcgtccctcttcttcttgttgctgttgaagaatttcacgttcatatcctccttgatggtctcgacgctcttctggatgctctggtcgtccttgaagttcttgaagagcttgaagtagaagctcacgatctgggactgcatgatctttctatcggactcctccttccagttcttcagaatgccgagaaacagtgtgccgttatcggccacgtcggagtggccggcattgaagtacttcttgaggttctcggcctccttcacgtaggggtcttggcagtagcagcccagagagcccagcacgatgcacagctggaaggccagaatgtagctggtgtacttcatggggccggggttctcctcgacatctccggcttgcttcagcagagagaaattggtggcgccgctgcccatttgccgaagagccctcaggctggactgcaggaactccttaaagctgcgcagaatgagatgagttgtcatgtcctgcagccactggttctgtgcctgcagcttcgtcagcaggctggcatttgtggttgggtcaggggtggttattgcatctagattctttgcctttttctgcaggaactggatcaggacttttgtactcatctgcacagctctggcttgttcctcactactctcaaatctgttctggaggtactctaggtatacctcaaactccaaaagaccagtgatgattttcaccaggcaagtctcctcattgaatccagattggaagcatccatctttttcagccatctttggaaggttcaggttgttttctgccagtgcctctttgctgctttcacacatgttactcttgttacatgtctcctttctcagggctgagatgccgtcgaggatgtaccgaatttgtttgtcaattcgttctgaagaggtgagtggctgtctgtgtggggcggctacatctttggaatcttctcctgggggtactggggcagggaaggcagcaggcaacaccaggagcagccccagggagaaggcaactggaccgaaggcgcttgtggagaaggagttcatggtggccaggagttgaggttactgtgagtagtgattaaagagagtgatagggaactcttgaacaagagatgcaatttatactgttaattctggaaaaatattatgggggtgtcaaaatgtcccgggaccaattgacgccttctgtatgaaacagtttttcctcctaattgacgccttctgtatgaaacagtttttcctcctaattgacgccttctgtatgaaacagtttttcctcctaattcgatgggaccaattgacgccttctgtatgaaacagtttttcctcctaattgacgccttctgtatgaaacagtttttcctcctaattgacgccttctgtatgaaacagtttttcctcctaattcgatatcaagcttatcgataccgtcgacctcgatgaattcgctagcaaatccactttggctcga

SEQ ID NO: 317 - DNA, 390 bp, Artificial Sequence
  Synthesized
tcgaggtcgacggtatcgataagcttgatatcgaattaggaggaaaaactgtttcatacagaaggcgtcaattaggaggaaaaactgtttcatacagaaggcgtcaattaggaggaaaaactgtttcatacagaaggcgtcaattggtcccatcgaattaggaggaaaaactgtttcatacagaaggcgtcaattaggaggaaaaactgtttcatacagaaggcgtcaattaggaggaaaaactgtttcatacagaaggcgtcaattggtcccgggacattttgacacccccataatatttttccagaattaacagtataaattgcatctcttgttcaagagttccctatcactctctttaatcactactcacagtaacctcaactcctg

SEQ ID NO: 318 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 319 - DNA, 57 bp, Homo sapiens
gccacgaacttctctctgttaaagcaagcaggagacgtggaagaaaaccccggtcct

SEQ ID NO: 320 - protein, 326 aa, Homo sapiens
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 321 - DNA, 10436 bp, Artificial Sequence
  Synthesized
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgactctagaactagtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgccgcggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctggctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatcacgagactagcctcgacacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatcgacttaacttgtttattgcagcttataatggttacaaataaggcaatagcatcacaaatttcacaaataaggcatttttttcactgcattctagttttggtttgtccaaactcatcaatgtatcttatcatgtctggatctcaaatccctcggaagctgcgcctgtcttaggttggagtgatacatttttatcacttttacccgtctttggattaggcagtagctctgacggccctcctgtcttaggttagtgaaaaatgtcactctcttacccgtcattggctgtccagcttagctcgcaggggaggtggtctcagtcgttggagccgaagtccagagagatgatggtgtctccagcggcgggggccagcagtgtcagagcatcgggctccttcttcagcttgtcaaacagagagctggtgtcctcgctctccaccttggtgaagagctgggtcatcttcatgtcgctgctctccacgggcttcagcacgcactcggtctgctgcagagagaagatcagatcgtgctggatgattcctctggcagcggcctctctagcagcggcttcgctggcgttcaggtagctcatcacccggtcgatggtcacggcccggatccggaaggcatgcaggaggatgcacagcttgatcttggtcttgtagaagtcgggctcttccaggctggacttctggggcactgtctcgctgttgaagttcagggcctgcatcagctcgtcgatcacggccagcatgttctgatccaggaagatctgccgcttggggtccatcagcagcttggcgttcatggtcttgaactccacctggtacatcttcaggtcctcgtagatgctgctcaggcacagggccatcatgaagctggtctttctgctggccaggcaagagccgttggtgatgaagcttgtctcccgagagttcagacagctctcgttcttggtcagttccaggggcaggcaggcctccacggtgctggtcttatccttggtgatgtcctcgtggtcgatttcctcgctggtgcaggggtagaattccagggtctgccgggccttctgcagcatgttgctcacggcccgcagcaggttctggctgtggtgcaggcaggggaacatgccggggtcgggggtagccacgggcaggttccggcttcctccgccccctccgccgctgcagggcacgctggcccactcggaccaggagctgctgtagtaccggtcctgggcccgcacgctgatgctggcgttcttccggcagatcacggtggcgctggtcttgtcggtgaacacccggtctttcttctcccgcttgctcttgccctgcacctgcacacagaaggtcaggctgaagtagctgtggggggtggaccaggtgtcagggtactcccaggacacctccacctgccggctgttcttcaggggcttcagctgcaggttcttgggggggtcgggcttgatgatgtcccggatgaaaaagctggaggtgtagttctcgtacttcagcttgtgcacggcgtccaccatcacctcgatgggcaggctttcctcggcggcagggcaggcgctatcttcctggcactcgacgctgtactcgtactctttgttgtcgccccgcactctctcggcgctcagggtggcggctccgcaggtcacgccctgagggtcgctgctgccccggctgctcttcacgctgaaggtcaggtcggtgctgatggtggtcagccaccaacaggtgaaccggccgctgtagttcttggcctcgcaccgcaggaaggtcttgttcttgggctctttctggtccttcaggatgtcggtggaccagatgccatcctctttcttgtgcagcagcagcaggctgtgggacagcacttcgccgcccttgtggcaggtgtactggccggcgtcgccgaactctttgacctggatggtcagggtcttgccgctgcccagcacctcgctgctctggtccagggtccaggtgatgccgtcctcttcgggggtgtcgcaggtcagcaccaccatctcgccaggggcgtcgggataccagtccagctccaccacgtacacgtctttcttcagctcccagatggccaccagggggctggccaggaacaccaggctgaaccagctgatgaccagctgctgatgacacatggtggccaggagttgaggttactgtgagtagtgattaaagagagtgatagggaactcttgaacaagagatgcaatttatactgttaattctggaaaaatattatgggggtgtcaaaatgtcccgggaccaattgacgccttctgtatgaaacagtttttcctcctaattgacgccttctgtatgaaacagtttttcctcctaattgacgccttctgtatgaaacagtttttcctcctaattcgatgggaccaattgacgccttctgtatgaaacagtttttcctcctaattgacgccttctgtatgaaacagtttttcctcctaattgacgccttctgtatgaaacagtttttcctcctaattcgatatcaagcttatcgataccgtcgacctcgatgaattcgctagcaaatccactttggctcgagaagcttgatat

SEQ ID NO: 322 - protein, 219 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 323 - protein, 74 aa, Artificial Sequence
  Synthesized
GIIQHDLIFSLQQTECVLKPVESSDMKMTQLFTKVESEDTSSLFDKLKKEPDALTLLAPAAGDTIISLDFGSND

SEQ ID NO: 324 - protein, 485 aa, Artificial Sequence
  Synthesized
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 325 - protein, 264 aa, Artificial Sequence
  Synthesized
MALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSS

SEQ ID NO: 326 - protein, 267 aa, Artificial Sequence
  Synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKGGGGSGGGGSGGGGSQIQLVQSGPELKKPGETVKISCKASGYTFTNYGMNWVKQAPGKGLKWMGWINTNTGEPTYAEEFKGRFAFSLETSASTAYLQINNLKNEDTATYFCARLGFGNAMDYWGQGTSVTVSS

SEQ ID NO: 327 - protein, 264 aa, Artificial Sequence; identical to SEQ ID NO: 325
  Synthesized

SEQ ID NO: 328 - protein, 754 aa, Artificial Sequence; identical to SEQ ID NO: 292
  Synthesized

SEQ ID NO: 329 - protein, 753 aa, Artificial Sequence
  Synthesized
MALPVTALLLPLALLLHAARPQSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 330 - protein, 753 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 331 - protein, 750 aa, Artificial Sequence
  Synthesized
MALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSGGGGSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 332 - protein, 750 aa, Artificial Sequence
  Synthesized
MALPVTALLLPLALLLHAARPQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSGGGGSGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 333 - protein, 750 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 334 - protein, 750 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSGGGGSEVQLVQSGAEVKKPGESLKISCKGSGYTFTNYWIGWVRQMPGKGLEWMGRIYPSDSYTNYSPSFQGQVTISADKSISTAYLQWSSLKASDTAMYYCARDLEPTHHYSWGQGTLVTVSSGGGGSGGGGSGGGGSQSVLTQPASVSGSPGQSVTISCTGTSSDVGGYNYVSWYQQHPGKPPKLMIYEVSKRPSGVPDRFSGSKSGNTASLTISGLQAEDEADYYCSSHTSSNTLIFGGGTKVTVLAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 335 - protein, 265 aa, Artificial Sequence
  Synthesized
MSPAQFLFLLVLWIQETNGDVVMTQTPLTLSVTIGQPASISCKSSQSLLYSNGKTYLNWLLQRPGQSPKRLIYLVSKLDSGVPDRFTGSGSGTDFTLKISRVEAEDLGVYYCVQGTHFPHTFGGGTKLEIKRMNFGLSLIFLVLVLKGVQCEVKVVESGGGLVKPGASLKLSCAASGFTFSNYGMSWVRQTSDKRLEWVASISSGGDSTFYADNVKGRFTISRENAKNTLYLQMSSLKSEDTALYYCARDDLFNWGQGTTLTVSS

SEQ ID NO: 336 - protein, 254 aa, Artificial Sequence
  Synthesized
VTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGILGSGGGGSGGGGSGGGGSQPVLTQSSSLSASPGASASLYHRCTLRSGINVGPYRIYWYQQSYSPGSPPQYLLNYKSDSDKQQGSGVPSRFSGSKDASANAGVLLISGLRSEDEADYYCMIWHSSAAVFGGGTQLTVLSAS

SEQ ID NO: 337 - protein, 262 aa, Artificial Sequence
  Synthesized
MVLLVTSLLLCELPHPAFLLIPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 338 - protein, 263 aa, Artificial Sequence
  Synthesized
MGWSCIILFLVATATGVHSDIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRGGSGSGGSGSGGSGSEVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSAKP

SEQ ID NO: 339 - protein, 311 aa, Artificial Sequence
  Synthesized
DVVMTQSPLSLPVTPGEPASISCRSSQSLVHSNANTYLHWYLQKPGQSPQLLIYKVSNRFSGVPDRFSGSGSGTDFTLKISRVGAGDVGVYYCSQNTHVPPTFGQGTKLEIKRGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSTTTPAPRPPTPAPTIASQPLSLRPEACRPAAGGAVHTRGLDFALECDFWVLVVVGGVLACYSLLVTVA

SEQ ID NO: 340 - protein, 343 aa, Artificial Sequence
  Synthesized
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVAKDVSQEDPEVQFNWYVDVVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 341 - protein, 111 aa, Artificial Sequence
  Synthesized
TTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCEL

SEQ ID NO: 342 - protein, 117 aa, Artificial Sequence
  Synthesized
TTTPAPRPPTPAPTIASQPLSLRPEACRPAAGGAVHTRGLDFACDIYIWAPLAGTCGVLLLSLVITLYCQRRKYRSNKGESPVEPAEPCHYSCPREEEGSTIPIQEDYRKPEPACSP

SEQ ID NO: 343 - protein, 141 aa, Artificial Sequence
  Synthesized
TTTPAPRPPTPAPTIASQPLSLRPEACRPAAGGAVHTRGLDFACDIYIWAPLAGTCGVLLLSLVITLYCNSRRRCGQKKKLVINSGNGAVEDRKPSGLNGEASKSQEMVHLVNKESSETPDQFMTADETRNLQNVDMKIGV

SEQ ID NO: 344 - protein, 129 aa, Homo sapiens
TTTPAPRPPTPAPTIASQPLSLRPEACRPAAGGAVHTRGLDFACDIYIWAPLAGTCGVLLLSLVITLYCCVKRRKPRGDVVKVIVSVQRKRQEAEGEATVIEALQAPPDVTTVAVEETIPSFTGRSPNH

SEQ ID NO: 345 - protein, 286 aa, Homo sapiens
NCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 346 - protein, 94 aa, Homo sapiens
NCRNTGPWLKKVLKCNTPDPSKFFSQLSSEHGGDVQKWLSSPFPSSSFSPGGLAPEISPLEVLERDKVTQLLPLNTDAYLSLQELQGQDPTHLV

SEQ ID NO: 347 - protein, 92 aa, Homo sapiens
NRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 348 - protein, 219 aa, Homo sapiens
HYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 349 - protein, 285 aa, Homo sapiens
SLKTHPLWRLWKKIWAVPSPERFFMPLYKGCSGDFKKWVGAPFTGSSLELGPWSPEVPSTLEVYSCHPPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 350 - protein, 223 aa, Homo sapiens
CFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 351 - protein, 69 aa, Homo sapiens
LVLKYRGLIKYWFHTPPSIPLQIEEYLKDPTQPILEALDKDSSPKDDVWDSVSIISFPEKEQEDVLQTL

SEQ ID NO: 352 - protein, 569 aa, Homo sapiens
KIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 353 - protein, 112 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 354 - protein, 112 aa, Artificial Sequence
  Synthesized
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDAYRHQALPPR

SEQ ID NO: 355 - protein, 83 aa, Artificial Sequence
  Synthesized
RVKFSRSADAPAFQQGQNQLFNELNLGRREEFDVLDKRQEGLFNELQKDKMAEAFSEIGMKHDGLFQGLSTATKDTFDALHMQ

SEQ ID NO: 356 - protein, 88 aa, Artificial Sequence
  Synthesized
RVKFSRSADAPAFQQGQNQLFNELNLGRREEFDVLDKRQEGLFNELQKDKMAEAFSEIGMKHDGLFQGLSTATKDTFDAYRHQALPPR

SEQ ID NO: 357 - protein, 112 aa, Artificial Sequence
  Synthesized
RVKFSRSADAPAFQQGQNQLFNELNLGRREEFDVLDKRRGRDPEMGGKPRRKNPQEGLFNELQKDKMAEAFSEIGMKGERRRGKGHDGLFQGLSTATKDTFDALHMQALPPR

SEQ ID NO: 358 - protein, 112 aa, Artificial Sequence
  Synthesized
RVKFSRSADAPAFQQGQNQLFNELNLGRREEFDVLDKRRGRDPEMGGKPRRKNPQEGLFNELQKDKMAEAFSEIGMKGERRRGKGHDGLFQGLSTATKDTFDAYRHQALPPR

SEQ ID NO: 359 - protein, 504 aa, Artificial Sequence
  Synthesized
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 360 - protein, 287 aa, Homo sapiens
INCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 361 - protein, 4 aa, Homo sapiens
  misc_feature (2)..(3): Xaa can be any naturally occurring amino acid
YXXQ

SEQ ID NO: 362 - protein, 4 aa, Homo sapiens
YRHQ

SEQ ID NO: 363 - protein, 4 aa, Homo sapiens
  misc_feature (2)..(3): Xaa can be any naturally occurring amino acid
YXXL

SEQ ID NO: 364 - protein, 13 aa, Artificial Sequence
  Synthesized
CAVRSGGYQKVTF

SEQ ID NO: 365 - protein, 15 aa, Artificial Sequence
  Synthesized
CASSSGQGVTYEQYF

The invention claimed is:

1. A method of expanding lymphocytes or enhancing expansion of lymphocytes, the method comprising:

administering an effective amount of lymphocytes to a subject having a solid tumor;

administering an effective amount of an agent to the subject, wherein the agent stimulates or activates antigen presenting cells (APCs) of the subject, and wherein the agent comprises a chimeric antigen receptor (CAR) T cell binding a B cell, a bispecific antibody binding a B cell and a T cell, an antibody binding a B cell, or a combination thereof; and allowing the lymphocytes to expand in the subject.

2. The method of claim 1, wherein the APCs comprise dendritic cells, macrophages, Langerhans cells, B cells, T cells, or a combination thereof.

3. The method of claim 1, wherein the APCs comprise B cells.

4. The method of claim 1, wherein the agent stimulates or activates B cells to differentiate into plasma cells.

5. The method of claim 1, wherein the agent comprises an antibody binding a B cell.

6. The method of claim 1, wherein the agent comprises a single-chain variable fragment (scFv) binding a B cell.

7. The method of claim 1, wherein the lymphocytes comprise T cells or NK cells, or a combination thereof.

8. The method of claim 1, wherein the agent binds a B cell antigen.

9. The method of claim 8, wherein the B cell antigen comprises CD19, CD20, CD22, CD53, CD138, BCMA, CD38, FCRL5, or a combination thereof.

10. The method of claim 1, wherein the APCs comprise B cells, and the agent stimulates or activates the B cells to up-regulate CD40, CD80, CD86, or a combination thereof on the B cells.

11. The method of claim 1, wherein the APCs comprise B cells, and the agent stimulates or activates B cells to up-regulate CCL17 and CCL22.

12. The method of claim 1, wherein the APCs comprise B cells, and wherein the agent stimulates or activates the B cells such that at least a portion of the B cells differentiate into plasma cells or into cells having one or more phenotypes of a plasma cell.

13. The method of claim 1, wherein the lymphocytes comprise a CAR or T cell receptor (TCR).

14. The method of claim 13, wherein the CAR comprises an antigen-binding domain, a transmembrane domain, and an intracellular signaling domain.

15. The method of claim 14, wherein the antigen-binding domain binds a tumor antigen comprising MUC1 (tMUC1), PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, CLDN 18.2, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, MAGE A4, EGFR, or a combination thereof.

16. The method claim 14, wherein the CAR comprises an antigen-binding domain, a transmembrane domain, and an intracellular signaling domain, and wherein the intracellular signaling domain comprises a signaling domain, or a signaling domain and a co-stimulatory signaling domain, and wherein the signaling domain and co-stimulatory signaling domain comprise a functional signaling domain of a protein comprising CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKp44, NKp30, NKp46, NKG2D, or a combination thereof.

17. The method of claim 13, wherein the TCR is a modified TCR, the TCR is derived from spontaneously occurring tumor-specific T cells in a patient, and/or the TCR binds a tumor antigen.

18. The method of claim 17, wherein the tumor antigen comprises CEA, gp100, MART-1, p53, MAGE-A3, NY-ESO-1, or a combination thereof.

19. A method of expanding T cells or enhancing expansion of T cells, the method comprising:

administering an effective amount of T cells to a subject having solid tumor;

administering an effective amount of an agent to the subject, wherein the agent stimulates or activates B cells of the subject, and wherein the agent comprises a CAR T cell binding a B cell, a bispecific antibody binding a B cell and a T cell, an antibody binding a B cell, or a combination thereof; and allowing the T cells to expand in the subject.

20. The method of claim 19, wherein the agent stimulates or activates the B cells to differentiate into plasma cells or to up-regulate CCL17 and CCL22.

21. The method of claim 19, wherein the agent comprises an antibody binding a B cell.

* * * * *